US009056909B2

(12) United States Patent
Chu et al.

(10) Patent No.: US 9,056,909 B2
(45) Date of Patent: Jun. 16, 2015

(54) MYCOPLASMA HYOPNEUMONIAE AVIRULENT ADJUVANTED LIVE VACCINE

(75) Inventors: Hsien-Jue Chu, Bonner Springs, KS (US); Zhichang Xu, Fort Dodge, IA (US); Wumin Li, Fort Dodge, IA (US); Nicole Rae Gibson, Humboldt, IA (US)

(73) Assignee: Zoetis Services LLC, Florham Park, NJ (US)

( * ) Notice: Subject to any disclaimer, the term of this patent is extended or adjusted under 35 U.S.C. 154(b) by 0 days.

(21) Appl. No.: 12/265,274

(22) Filed: Nov. 5, 2008

(65) Prior Publication Data

US 2009/0117152 A1    May 7, 2009

Related U.S. Application Data

(60) Provisional application No. 60/985,811, filed on Nov. 6, 2007.

(51) Int. Cl.
*A61K 39/02* (2006.01)
*C12N 1/02* (2006.01)
*C07K 14/30* (2006.01)
*A61K 39/116* (2006.01)
*A61K 39/00* (2006.01)

(52) U.S. Cl.
CPC ............. *C07K 14/30* (2013.01); *A61K 39/0241* (2013.01); *A61K 39/116* (2013.01); *A61K 2039/522* (2013.01); *A61K 2039/55566* (2013.01)

(58) Field of Classification Search
CPC .................................. A61K 39/02; C12N 1/02
USPC ...................................... 424/264.1; 435/252.1
See application file for complete search history.

(56) References Cited

U.S. PATENT DOCUMENTS

| | | | |
|---|---|---|---|
| 3,917,619 | A | 11/1975 | Yoshioka et al. |
| 4,824,785 | A | 4/1989 | Acree et al. |
| 4,894,332 | A | 1/1990 | Schaller et al. |
| 6,001,348 | A | 12/1999 | Witvliet |
| 7,056,492 | B2 | 6/2006 | Goudie et al. |
| 7,276,353 | B2 | 10/2007 | Meng et al. |
| 7,279,166 | B2 | 10/2007 | Meng et al. |
| 2003/0017171 | A1 | 1/2003 | Chu et al. |
| 2003/0091595 | A1 | 5/2003 | Chu |
| 2003/0170270 | A1 | 9/2003 | Meng et al. |
| 2004/0253270 | A1 | 12/2004 | Meng et al. |
| 2005/0053627 | A1 | 3/2005 | Leonard et al. |

FOREIGN PATENT DOCUMENTS

| | | |
|---|---|---|
| CA | 2208790 | 6/1997 |
| EP | 283840 A2 | 9/1988 |
| EP | 0571648 A1 | 1/1993 |
| JP | S62-273456 | 11/1987 |
| WO | 8600019 A1 | 1/1986 |
| WO | 9203157 | 3/1992 |
| WO | 9817310 | 4/1998 |
| WO | WO 02/10343 A | 2/2002 |
| WO | 0249666 A2 | 6/2002 |
| WO | 03003941 A2 | 1/2003 |
| WO | 03024354 A2 | 3/2003 |
| WO | 03086473 A1 | 10/2003 |
| WO | WO2004/058142 A2 | 7/2004 |
| WO | WO 2004/058142 A2 | 7/2004 |
| WO | 2004080400 A2 | 9/2004 |

OTHER PUBLICATIONS

Etheridge et al., *A Method for Assessing Induced Resistance to Enzootic Pneumonia of Pigs*. Res. Vet. Sci. (1982) 33:188-191.
Kristensen et al., *Cell-Mediated and Humoral Immune Response in Swine After Vaccination and Natural Infection with Mycoplasma hyopneumoniae*. Am. J. Vet. Res. (1981) 42:784-788.
Ross et al., *Characteristics of protective activity of Mycoplasma hyopneumoniae vaccine*. Am. J. Vet. Res. (1984) 45:1899-1905.
Amaral de Castro et al., *Variable number of tandem aminoacid repeats in adhesion-related CDS products in Mycoplasma hyponeumoniae strains*. Veterinary Microbiology. (2006) 116:258-269.
Vasconcelos et al., *Swine and Poultry Pathogens: the Complete Genome Sequences of Two Strains of Mycoplasma hyopneumoniae and a Strain of Mycoplasma synoviae..* J. Bacteriol. (2005) 187(16):5568-5577.
Djordjevic et al., *Proteolytic Processing of the Mycoplasma hyopneumoniae Cilium Adhesin*. Infection and Immunity. (2004) 72(5):2791-2802.
King et al., *Immunofluorescence of Feline Panleucopenia Virus in Cell Culture: Determination of Immunological Status of Felines by Serum Neutralization*. Journal of Comparative Medicine and Vet. Science, (1965) 29: 85-89.
Thacker et al., *Mycoplasma hyopneumoniae Potentiation of Porcine Reproductive and Respirator Syndrome Virus-Induced Pneumonia*. J. Clin. Microbiol. (1999) 37(3):620-627.
International Search Report dated Feb. 6, 2009.

(Continued)

*Primary Examiner* — Jennifer Graser
(74) *Attorney, Agent, or Firm* — Gloria K. Szakiel; Barbara L. Renda

(57) ABSTRACT

Provided are immunogenic and vaccine compositions and methods for their preparation and use, which compositions are effective in protecting against, minimizing the severity of, preventing, and/or ameliorating M. hyopneumoniae infection. Administration to an animal of one or two doses of an adjuvanted live avirulent M. hyopneumoniae composition disclosed herein is effective in providing immunity to the animal and protection from infection with a virulent strain of M. hyopneumoniae thereby reducing the severity of and/or preventing disease caused by one or more virulent strain of M. hyopneumoniae. Also provided are compositions, which further comprise one or more antigen such as, for example, one or more live bacteria, bacterin, toxoid, and/or virus and/or viral antigen. Exemplified are immunogenic compositions, comprising an adjuvanted live avirulent M. hyopneumoniae and compositions, comprising Porcine Circovirus Type 1-Type 2 chimera modified live vaccine (cPCV1-2) in further combination with an adjuvanted live avirulent M. hyopneumoniae.

23 Claims, No Drawings

(56) References Cited

OTHER PUBLICATIONS

Morrow C J et al: "Production of Temperature-Sensitive Clones of Mycoplasma Synoviae for Evaluation as Live Vaccines" Avian Diseases, American Association of Avian Pathologists, Kennet SQ., PA, US, vol. 42, Jan. 1, 1993, pp. 687-870.

Lai W C et al: "Biologioal Evaluation of Mycoplasma-Pulmonis Temperature-Senstive Mutants for Use as Possible Rodent Vaccines" Infection and Immunity, American Society for Microbiology. Washington, vol. 58, No. 7, Jul. 1, 1990, pp. 2289-2296.

Javed Mohammed A et al: "Correlates of immune protection in chickens vaccinated with Mycoplasma gallisepticum strain GT5 following challenge with pathogenic M-gallisepticum strain R-low" Infection and Immunity, American Society for Microbiology. Washington, vol. 73, No. 9, Sep. 1, 2005, pp. 5410-5419.

Evans R D et al: "Evaluation OP a Mycoplasma-Gallisepticum Strain Exhibiting Reduced Virulence for Prevention and Control of Poultry Mycoplasmosis" Avian Diseases, American Association of Avian Pathologists, Kennet SQ., PA, US, vol. 36, No. 2, Jan. 1, 1992, pp. 197-201.

Alessandri Enrico et al: "Field trials with the use of a live attenuated temperature-sensitive vaccine for the control of Mycoplasma gallisepticum infection in meat-type turkeys" Italian Journal of Animal Science,, vol. 4, No. 3, Jul. 1, 2005, pp. 282-286.

Fort Dodge Australia (2000) TechNote—Technical Update TF S04-00 (1) "Suvaxyn M.Hyo—How it works".

J. Tully and R.F. Whitcomb (volume editors) Mycoplasmas vol. 2: Human and Animal Mycoplasmas (1979), pp. 142-143.

Minion et al. "The Genome Sequence of Mycoplasma hyopneumoniae Strain 232, the Agent of Swine Mycoplasmosis", Journal of Bacteriology, vol. 186, No. 21, (2004) pp. 7123-7133.

Blank et al. "A physical and genetic map of the Mycoplasma hyopneumoniae strain J genome" Canadian Journal of Microbiology, vol. 46, (2000), pp. 832-840.

Petrovsky et al. "Vaccine adjuvants: Current state and future trends" Immunology and Cell Biology, vol. 82, (2004). pp. 488-496.

Bouh et al, "Monoclonal Antibodies to *Escherichia coli*-Expressed P46 and P65 Membranous Proteins for Specific Immunodetection of Mycoplasma hyopneumoniae in Lungs of Infected Pigs", Clinical and Diagnostic Laboratory Immunology, vol. 10 No. 3, May 2003, pp. 459-468.

Burnett et al. "P159 is a proteolytically processed, surface adhesin of Mycoplasma hyopneumonia defined domains of P159 bind heparin and promote adherence to eukaryote cells", Molecular Microbiology (Mar. 13, 2006) 60(3), 669-686.

MYCOPLASMA HYOPNEUMONIAE AVIRULENT ADJUVANTED LIVE VACCINE

CROSS-REFERENCE TO RELATED APPLICATIONS

This application claims the benefit under 35 U.S.C. §119(e) of U.S. Provisional Application No. 60/985,811 filed on Nov. 6, 2007, the disclosure of which is incorporated by reference herein in its entirety.

FIELD OF THE INVENTION

The present disclosure relates generally to the fields of immunology and veterinary medicine. More specifically, the present disclosure provides adjuvanted live avirulent *M. hyopneumoniae* compositions based on a J strain of *M. hyopneumoniae*, including immunogenic or vaccine compositions, which aid in reducing the severity of and/or in preventing disease caused by one or more virulent strain of *M. hyopneumoniae*. Also provided are adjuvanted live avirulent *M. hyopneumoniae* compositions, including immunogenic or vaccine compositions, further comprising Porcine Circovirus Type 1-Type 2 chimera modified live vaccine (cPCV1-2). One or two-dose administration to an animal of an adjuvanted live avirulent *M. hyopneumoniae* composition disclosed herein is effective in providing immunity, including cell-mediated immunity and/or humoral immunity, from infection with a virulent strain of *M. hyopneumoniae*.

BACKGROUND OF THE INVENTION

*Mycoplasma hyopneumoniae* (also referred to as *M. hyopneumoniae*) is the etiologic agent of swine mycoplasmal pneumonia. The disease causes a chronic cough, dull hair coat, retarded growth and unthrifty appearance lasting several weeks. Characteristic lesions of purple to gray areas of consolidation, particularly in ventral apical and cardiac lobes are observed in infected animals. Although the disease causes little mortality, affected swine are often prone to secondary infections by opportunistic pathogens, resulting in death or stress. (R. F. Ross, Mycoplasmal diseases, pp. 436-444, in A. D. Laman, et al., (eds.) Diseases of Swine, Iowa State University Press, 1986).

The disease is believed to be one of the most important causes of disease-associated loss in swine (Whittlestone, pp. 133-176, in Tully and Whitcomb (eds.), The *Mycoplasma* Vol 2: Human and Animal Mycoplasmas, New York, Academic Press, (1979)). The disease generally results in inefficient weight gainers, and in stunted and sickly animals. Also, affected swine are often prone to secondary infection by opportunistic organisms (Burch, Pig America pp. 26-27, December, 1982). The economic impact of the disease is significant. Economic losses alone have been estimated at between 200 to 250 million dollars annually.

*Mycoplasma hyopneumoniae* is a slow growing, fastidious bacterium that lacks a cell wall. It is frequently difficult to isolate from the respiratory tract due to *Mycoplasma hyorhinis*, a common secondary agent also located in the respiratory tract. The disease is spread by aerosol, produced by coughing, and by direct contact from an affected or convalescent carrier swine. Mingling of infected animals and uninfected animals results in early and frequent reinfection. Infection frequently starts with infection of piglets by carrier sows at farrowing.

Due to herd management techniques, infection may not become evident until later in life. Additional infection usually is observed after weaning when pigs are pooled. Overt disease is normally observed in pigs at six weeks of age or older. Growth rates and feed conversion rates are markedly reduced in affected animals. Existing treatments using antibiotics are expensive and require prolonged use. Animal reinfection remains a problem.

Thus, vaccines are presently the most effective method for avoiding infections and their consequences. There have been numerous attempts to provide a vaccine for protecting swine against *Mycoplasma hyopneumoniae* infection. Several investigators have disclosed vaccines comprising recombinantly produced surface antigens of *Mycoplasma hyopneumoniae*, Schaller et al., U.S. Pat. No. 4,894,332, issued Jan. 16, 1990; European Patent Publication No. 283,840, published Sep. 28, 1988. PCT Publication No. WO 86/00019, published Jan. 3, 1986, discloses a *Mycoplasma hyopneumoniae* vaccine comprising exclusively *Mycoplasma hyopneumoniae* plasma membranes, free of other cell components. Etheridge et al., Res. Vet. Sci. 33:188 (1982), found incomplete protection against lung colonization by *Mycoplasma hyopneumoniae* when a live vaccine was given intravenously, subcutaneously, or intraperitoneally. Kristensen et al., Am. J. Vet. Res. 42:784 (1981), found no protection of swine against mycoplasmal pneumonia after injection with heat-inactivated *Mycoplasma hyopneumoniae*. Ross et al., Am. J. Vet. Res. 45:1899 (1984), found that use of *Mycoplasma hyopneumoniae* extracts prepared by a freeze-thaw procedure to immunize swine, provided only variable protection, and in some instances, enhanced lesion development was noted in immunized swine. These investigators also studied a whole-cell vaccine prepared by formalin inactivation. Formalin inactivation significantly hindered the protective immunogenicity of *Mycoplasma hyopneumoniae*, and this vaccine was not effective. Yoshioka et al., U.S. Pat. No. 3,917,819 (issued Nov. 4, 1975) discloses several killed Mycoplasma vaccines comprising Mycoplasma inactivated with formalin, including an inactivated vaccine for *Mycoplasma hyopneumoniae*. Chung-Nan European Patent Publication 571,648 disclosed an *M. hyopneumoniae* vaccine based on the highly proliferative and antigenic strain PRIT-5.

Vaccines based on inactivated virulent *Mycoplasma hyopneumoniae* strains are commercially available. Fort Dodge Animal Health (FDAH) markets *Mycoplasma hyopneumoniae* bacterin under the name Suvaxyn® and Respifend® *Mycoplasma hyopneumoniae* for use as a vaccine to protect healthy swine against clinical signs caused by *Mycoplasma hyopneumoniae*. This bacterin vaccine is recommended as a two-dose vaccine for pigs at least one-week old, with the second dose two to three weeks after the first vaccination.

The *M. hyopneumoniae* J strain is a non-pathogenic strain with reduced capacity to adhere to porcine cilia and, therefore, to cause disease. Castro et al., *Veterinary Microbiology* 116:258-269 (2006) and Vasconcelos et al, *J. Bacteriol.* 187 (16):5568-5577 (2005) (describing the complete genome sequence of *M. hyopneumoniae* J strain (ATCC 25934)). Genomic comparisons between pathogenic and nonpathogenic strains (J strain) have revealed variations in surface proteins, including cilium adhesin, that are believed to be determinative of relative pathogenic properties between *M. hyopneumoniae* strains. Vasconcelos et al. (2006) and Djordjevic et al., *Infection and Immunity* 72(5):2791-2802 (2004).

*M. hyopneumonia* expresses, on its cell surface, membranous lipoproteins, particularly the P46, P65, and P97 proteins, which carry species-specific antigenic determinants. Recently, Bouh et al. described monoclonal antibodies to P46 and P65 of live avirulent *M. hyopneumoniae* reference J strain ATCC 25934. *Clin. Diag. Lab. Immunology* 10(3):459-468 (2003). Blank and Stemke described a physical and genetic map of *M. hyopneumoniae* strain J genome, *Can. J. Microbiol.* 46:832-840 (2000), and Wilton et al. described the screening of expression libraries generated from the non-pathogenic *M. hyopneumoniae* J strain and the screening of those libraries with porcine hyperimmune antiserum against *M. hyopneumoniae*.

There is a need for compositions, including immunogenic or vaccine compositions, made from live adjuvanted avirulent *Mycoplasma hyopneumoniae*, which compositions provide efficacy against virulent strains of *M. hyopneumoniae*. The citation of any reference herein should not be deemed as an admission that such reference is available as prior art to the instant invention.

SUMMARY OF THE INVENTION

The present disclosure provides compositions, including immunogenic compositions or vaccine compositions, comprising an immunologically effective amount of a live avirulent *Mycoplasma hyopneumoniae* and a biologically acceptable adjuvant. Compositions disclosed herein elicit an immune response against *Mycoplasma hyopneumoniae*, thereby preventing and/or minimizing the severity of disease caused by this organism or ameliorating at least one symptom associated with the disease.

Accordingly, in one aspect, the invention provides a composition for eliciting an anti-*Mycoplasma hyopneumoniae* immune response in an animal, said composition comprising an immunologically effective amount of a live avirulent strain of *Mycoplasma hyopneumoniae* and a biologically acceptable adjuvant.

In one embodiment, the composition comprises a live avirulent strain of *Mycoplasma hyopneumoniae* whose genome comprises a nucleic acid sequence having at least about 90% homology to the nucleic acid sequence of a reference J strain.

In one embodiment, the composition comprises a live avirulent strain of *Mycoplasma hyopneumoniae* whose genome comprises a nucleic acid sequence having at least about 95% homology to the nucleic acid sequence of a reference J strain.

In one embodiment, the composition comprises a live avirulent strain of *Mycoplasma hyopneumoniae* whose genome comprises a nucleic acid sequence having at least about 99% homology to the nucleic acid sequence of a reference J strain.

In one embodiment, the composition comprises a live avirulent strain of *Mycoplasma hyopneumoniae* that has at least about 70% polymorphic identity to a reference J strain.

In one embodiment, the composition comprises a live avirulent strain of *Mycoplasma hyopneumoniae* that has at least about 85% polymorphic identity to a reference J strain.

In one embodiment, the composition comprises a live avirulent strain of *Mycoplasma hyopneumoniae* that has at least about 95% polymorphic identity to a reference J strain.

In one embodiment, the percent homology of the live avirulent strain of *Mycoplasma hyopneumoniae* used in the compositions described herein are determined by comparison to an avirulent reference J strain having ATCC accession number 25934 (GenBank Accession Number AE017243) or 27715. In other certain embodiments, the reference strain may be a strain that is a virulent strain, for example, those having ATCC accession numbers 25617 or 25095.

In one embodiment, the percent polymorphic identity of the live avirulent strain of *Mycoplasma hyopneumoniae* used in the compositions described herein are determined by comparison to an avirulent reference J strain having ATCC accession number 25934 or 27715. In other certain embodiments, the reference strain may be a strain that is a virulent strain, for example, those having ATCC accession numbers 25617 or 25095.

In one embodiment, the live avirulent strain of *Mycoplasma hyopneumoniae* used in the compositions described herein is a J strain designated as ATCC accession number 25934 or 27715.

In one embodiment, the live avirulent strain of *Mycoplasma hyopneumoniae* used in the compositions described herein is a J strain designated as ATCC accession number 27715.

In one embodiment, the immune response elicited by a live-avirulent strain of *Mycoplasma hyopneumoniae* protects an animal against infection with, or reduces the severity of at least one symptom associated with an infection by a virulent strain of *Mycoplasma hyopneumoniae*.

In one embodiment, one-dose administration to an animal of an adjuvanted live avirulent *M. hyopneumoniae* composition disclosed herein is effective in providing immunity to the animal from Mycoplasma infection.

In one embodiment, two-dose administration to an animal of an adjuvanted live avirulent *M. hyopneumoniae* composition disclosed herein is effective in providing immunity to the animal from *Mycoplasma* infection.

Adjuvanted live avirulent *Mycoplasma hyopneumoniae* vaccine compositions disclosed herein may be suitably employed for use in swine against infection and disease caused by *Mycoplasma hyopneumoniae* and will find utility in managing and/or preventing the spread of infection and disease caused by *Mycoplasma hyopneumoniae* in swine populations.

Thus, immunogenic compositions and vaccine compositions of the present disclosure employ one or more live avirulent *Mycoplasma hyopneumoniae* in combination with one or more adjuvant such as a biologically acceptable adjuvant. The biologically acceptable adjuvant may, optionally, be one or more adjuvant(s) selected from the group consisting of SP-Oil, SL-CD, an acrylic acid polymer (such as Carbopol®, Noveon, Inc., Cleveland, Ohio), and a mixture of a metabolizable oil such as one or more unsaturated terpene hydrocarbon(s), for example squalene or squalane, and a polyoxyethylene-polypropylene block copolymer such as Pluronic® (BASF, Florham Park, N.J.).

The concentration of adjuvant employed in the compositions described herein will depend upon the nature of the adjuvant. Adjuvants are typically present in the compositions described herein at a final concentration of about 1-50% (v/v) and more typically at a final concentration of about 10%, 15%, 20%, 25%, or 30% (v/v). In compositions comprising SP-Oil, the adjuvant is typically present at between about 1% and about 25% (v/v), more typically between about 5% and about 15% (v/v) such as, for example, at about 10% (v/v). In compositions comprising an acrylic acid polymer and a mixture of a metabolizable oil that comprises one or more terpene hydrocarbon(s) and a polyoxyethylene-polypropylene block copolymer, the ratio of acrylic acid polymer to metabolizable oil/polyoxyethylene-polypropylene block copolymer mixture is typically in a ratio of between about 1:25 and about 1:50 and typically at a final concentration of between about 1% and about 25% (v/v).

In one embodiment, the biologically acceptable adjuvant comprises SP-Oil. In one embodiment, the SP-Oil is present at a concentration of between about 1% and about 25% v/v. In one embodiment, the SP-Oil is present at a concentration of between about 5% and about 15% v/v. In one embodiment, the SP-Oil is present at a concentration of about 10% v/v.

Within certain embodiments, compositions disclosed herein may employ, in further combination, one or more other live bacteria, bacterin, toxoid, and/or viral antigen. Thus, within certain aspects of these embodiments, the adjuvanted live avirulent *M. hyopneumoniae* composition may comprise an immunologically effective amount of live avirulent *Mycoplasma hyopneumoniae* and one or more biologically acceptable adjuvant(s) in further combination with (a) one or more live bacteria; (b) one or more bacterin; (c) one or more purified toxoid from one or more pathogens such as, for example, *Haemophilus parasuis, Pasteurella multocida, Streptococcus suis, Actinobacillus pleuropneumoniae, Bordetella bronchiseptica, Salmonella choleraesuis, Erysipelothrix rhusiopathiae* and leptospira bacteria; and/or (d) one or more viral antigen wherein the virus is selected from the group consisting of swine influenza virus (SIV), porcine reproductive and respiratory syndrome virus (PRRSV), raccoon poxvirus expressing PRRS and/or other antigens, TGEV expressing PRRS and/or other antigens, and porcine circovirus (PCV). Within certain aspects of these embodiments, exemplified herein are compositions, including immunogenic compositions or vaccine compositions, which employ, in further combination, Porcine Circovirus Type 1-Type 2 chimera modified live vaccine (cPCV1-2). Within these or alternative embodiments, compositions, including immunogenic or vaccine compositions, may additionally or optionally include a preservative and stabilizer such as, for example, SGGK, thimerosol and/or EDTA.

The concentration of such other live bacteria, bacterin, toxoid, and/or viral antigen employed in the compositions described herein will depend upon the nature of the live bacteria, bacterin, toxoid, and/or viral antigen and are typically present in the compositions described herein. For such compositions wherein the other antigen is bacterial, the bacteria are typically present at a final concentration of between about $0.5 \times 10^5$ to $0.5 \times 10^{10}$ per milliliter. Alternatively, the bacteria are present at a final concentration of between about $0.5 \times 10^6$ to $0.5 \times 10^9$ per milliliter or at a final concentration of between about $0.5 \times 10^7$ to $0.5 \times 10^8$ per milliliter.

A second aspect of the invention provides methods for generating an immune response to *Mycoplasma hyopneumoniae*, or for protecting an animal against disease caused by *Mycoplasma hyopneumoniae* and/or for preventing or ameliorating an outbreak of such disease among animal populations by administering an adjuvanted live avirulent *Mycoplasma hyopneumoniae* composition as described herein. In a related aspect, the present disclosure also provides methods for enhancing an immune response to *Mycoplasma hyopneumoniae*. Such methods comprise the steps of administering to an animal, such as swine, in one or two doses, a composition comprising one or more adjuvanted live avirulent *Mycoplasma hyopneumoniae* strain.

In one embodiment the methods of the present invention use a live avirulent strain of *Mycoplasma hyopneumoniae* whose genome comprises a nucleic acid sequence having about 90% homology to the nucleic acid sequence of a reference J strain.

In one embodiment the methods of the present invention use a live avirulent strain of *Mycoplasma hyopneumoniae* whose genome comprises a nucleic acid sequence having about 95% homology to the nucleic acid sequence of a reference J strain.

In one embodiment the methods of the present invention use a live avirulent strain of *Mycoplasma hyopneumoniae* whose genome comprises a nucleic acid sequence having about 99% homology to the nucleic acid sequence of a reference J strain.

In one embodiment the methods of the present invention use a live avirulent strain of *Mycoplasma hyopneumoniae* that has at least about 70% polymorphic identity to a reference J strain.

In one embodiment the methods of the present invention use a live avirulent strain of *Mycoplasma hyopneumoniae* that has at least about 85% polymorphic identity to a reference J strain.

In one embodiment, the methods of the present invention use a live avirulent strain of *Mycoplasma hyopneumoniae* that has at least about 95% polymorphic identity to a reference J strain.

In one embodiment, the live avirulent strain of *Mycoplasma hyopneumoniae* used in the methods of the invention, as described herein, is a J strain designated as ATCC accession number 25934 or 27715.

In one embodiment, the live avirulent strain of *Mycoplasma hyopneumoniae* used in the methods of the invention, as described herein, is a J strain designated as ATCC accession number 27715.

In one embodiment, the invention provides a method for enhancing an immune response to *Mycoplasma hyopneumoniae*, the method comprising the steps of:
  a) at a first time, administering a first immunogenic composition comprising an immunologically effective amount of a live avirulent *Mycoplasma hyopneumoniae* strain adjuvanted with a biologically acceptable adjuvant material to an animal;
  b) at a second time, administering a second immunogenic composition comprising an immunologically effective amount of a live avirulent *Mycoplasma hyopneumoniae* adjuvanted with a biologically acceptable adjuvant material to an animal.

In certain embodiments, depending upon the precise application contemplated, compositions may be administered parenterally, such as through intramuscular, subcutaneous, or intraperitoneal injection, or by topical application of a cream. Alternatively, compositions may be administered through aerosol, intranasal, or oral routes, such as by intranasal spray or oral administration by hand delivery or mass application.

These and other embodiments, features and advantages of the invention will become apparent from the detailed description and the appended claims set forth herein below. All patents, patent applications, and other literature cited herein are hereby incorporated by reference in their entirety. In the case of inconsistencies, the present disclosure will prevail.

DETAILED DESCRIPTION OF THE INVENTION

Before the present methods and treatment methodology are described, it is to be understood that this invention is not limited to particular methods, and experimental conditions described, as such methods and conditions may vary. It is also to be understood that the terminology used herein is for purposes of describing particular embodiments only, and is not intended to be limiting.

As used in this specification and the appended claims, the singular forms "a", "an", and "the" include plural references unless the context clearly dictates otherwise. Thus, for example, references to "the method" includes one or more methods, and/or steps of the type described herein and/or which will become apparent to those persons skilled in the art upon reading this disclosure and so forth.

Accordingly, in the present application, there may be employed conventional molecular biology, microbiology, and recombinant DNA techniques within the skill of the art. Such techniques are explained fully in the literature. See, e.g., Sambrook, Fritsch & Maniatis, *Molecular Cloning: A Laboratory Manual*, Second Edition (1989) Cold Spring Harbor Laboratory Press, Cold Spring Harbor, N.Y. (herein "Sambrook et al., 1989"); *DNA Cloning: A Practical Approach*, Volumes I and II (D. N. Glover ed. 1985); *Oligonucleotide Synthesis* (M. J. Gait ed. 1984); *Nucleic Acid Hybridization* (B. D. Hames & S. J. Higgins eds. (1985)); *Transcription And Translation* (B. D. Hames & S. J. Higgins, eds. (1984)); *Animal Cell Culture* (R. I. Freshney, ed. (1986)); *Immobilized Cells And Enzymes* (IRL Press, (1986)); B. Perbal, *A Practical Guide To Molecular Cloning* (1984); F. M. Ausubel et al. (eds.), *Current Protocols in Molecular Biology*, John Wiley & Sons, Inc. (1994).

Although any methods and materials similar or equivalent to those described herein can be used in the practice or testing of the invention, the preferred methods and materials are now described. All publications mentioned herein are incorporated by reference in their entirety.

Definitions

The terms used herein have the meanings recognized and known to those of skill in the art, however, for convenience and completeness, particular terms and their meanings are set forth below.

The term "about" or "approximately" means within a statistically meaningful range of a value. Such a range can be within an order of magnitude, typically within 50%, more typically within 20%, more typically still within 10%, and even more typically within 5% of a given value or range. The allowable variation encompassed by the term "about" or "approximately" depends on the particular system under study, and can be readily appreciated by one of ordinary skill in the art.

"Adjuvant" means a composition comprised of one or more substances that enhances the antigenicity of live avirulent *Mycoplasma hyopneumoniae* in a composition, typically a vaccine composition. An adjuvant can serve as a tissue depot that slowly releases the antigen and also as a lymphoid system activator that non-specifically enhances the immune response (Hood, et al., *Immunology, Second Ed.*, Menlo Park, Calif.: Benjamin/Cummings, 1984. p. 384). Often, a primary vaccination with an antigen alone, in the absence of an adjuvant, will fail to elicit a humoral or cellular immune response. Adjuvants include, but are not limited to, complete Freund's adjuvant, incomplete Freund's adjuvant, mineral gels such as aluminum hydroxide, surface active substances such as lysolecithin, pluronic polyols, polyanions, peptides, oil or hydrocarbon emulsions, keyhole limpet hemocyanins, and potentially useful human adjuvants such as N-acetyl-muramyl-L-threonyl-D-isoglutamine (thr-MDP), N-acetyl-nor-muramyl-L-alanyl-D-isoglutamine, N-acetylmuramyl-L-alanyl-D-isoglutaminyl-L-alanine-2-(1'-2'-dipalmitoyl-sn-glycero-3-hydroxypholoxy)-ethylamine, BCG (bacille Calmette-Guerin) and *Corynebacterium parvum*. Preferably, the adjuvant is biologically acceptable.

Adjuvants employed in the compositions described herein are typically "biologically acceptable adjuvants" and, thus, may be used in combination with live avirulent *Mycoplasma hyopneumoniae* such that the resulting compositions may be administered in vivo without concomitant toxicity to an animal. Exemplified herein are compositions including live avirulent *Mycoplasma hyopneumoniae* in combination with one or more biologically acceptable adjuvant selected from the group consisting of SP-Oil, SL-CD, Carbopol, and a mixture of a metabolizable oil such as one or more unsaturated terpene hydrocarbon(s), for example squalene or squalane, and a polyoxyethylene-polypropylene block copolymer such as Pluronic®.

A live aviruient *Mycoplasma hyopneumoniae* strain or molecule therefrom is "antigenic" when it is capable of specifically interacting with an antigen recognition molecule of the immune system, such as an immunoglobulin (antibody) or T cell antigen receptor. Typically, an antigenic molecule is a polypeptide, or variant thereof, which contains an "epitope" of at least about five and typically at least about 10 amino acids. An antigenic portion of a polypeptide, also called herein the "epitope," can be that portion that is immunodominant for antibody or T cell receptor recognition, or it can be a portion used to generate an antibody to the molecule by conjugating the antigenic portion to a carrier polypeptide for immunization. A molecule that is antigenic need not be itself immunogenic, i.e., capable of eliciting an immune response without a carrier.

The term "at least" means not less than.

As used herein, a "bacterin" is a bacterium harvest that has been inactivated and that, in combination with certain adjuvants, can elicit protective immunity to protect against disease or infection when administered to animals.

Acrylic acid polymers are typically carbomers. Carbomers are commercially available under the trade name "Carbopol" and are described, for example, in U.S. Pat. Nos. 2,909,462 and 3,790,665, each of which is incorporated herein by reference.

The term "carrier" refers to a diluent, adjuvant, excipient, stabilizer, preservative, and/or vehicle with which a compound or composition is administered. Such carriers can be sterile liquids, such as water and oils, including those of petroleum, animal, vegetable or synthetic origin, such as peanut oil, soybean oil, mineral oil, sesame oil and the like. Water or aqueous solution saline solutions, for example, phosphate-buffered saline, Ringer's solutions and aqueous dextrose and glycerol solutions are frequently employed as carriers, particularly for injectable solutions. The carrier or diluent must be non-toxic and must not affect the biological activity of the antigen/immunogen. Other additional auxiliary substances, such as wetting or emulsifying agents, surfactants, pH buffering substances and the like may also be used in the compositions of the invention. Preservatives may include, for example, thimerosol and/or EDTA. Suitable pharmaceutical carriers are described in "Remington's Pharmaceutical Sciences" by E. W. Martin, 18$^{th}$ Edition. A wide variety of carriers are well known in the art, and the selection of specific carriers is well within the level of those skilled in the art.

The term "colony forming unit" or "CFU" is a unit of measure used to indicate the number of organisms capable of replication in a given sample. This is based on the theory that a colony is derived from the replication of a pair/cluster or single cell of bacteria.

The "immunologically effective amount" is the amount of live avirulent *Mycoplasma hyopneumoniae* that will elicit an immune response against *Mycoplasma hyopneumoniae*. The "immunologically effective amount" will depend upon the species, breed, age, size, health status of the recipient animal and will be influenced by the previous exposure of the animal to one or more strain of *Mycoplasma hyopneumoniae* whether that one or more strain is a virulent strain or an avirulent strain of *Mycoplasma hyopneumoniae*. As used herein, an "immunologically effective amount" of live avirulent *Mycoplasma hyopneumoniae*, when employed in combination with a suitable adjuvant, is that amount of *Mycoplasma hyopneumoniae* that is sufficient to enhance the immunogenicity of the live avirulent *Mycoplasma hyopneumoniae* and thus provides for protective immunity against challenge with a virulent *Mycoplasma hyopneumoniae* strain. In one embodiment, an immunologically effective amount is a minimum of about 1×10³ organisms. In one embodiment, an immunologically effective amount ranges from about 1×10³ colony forming units/ml (CFU/ML) to about 1×10¹¹ CFU/ML. In one embodiment, an immunologically effective amount is about 5×10⁷ CFU/ML.

As used herein, the term "immunogenic" means that the live avirulent *Mycoplasma hyopneumoniae* is capable of eliciting a humoral and/or cellular immune response. An immunogenic strain is also antigenic. An immunogenic composition is a composition that elicits a humoral and/or cellular immune response when administered to an animal.

The term "immunogenic composition" relates to any pharmaceutical composition containing an antigen, eg. a microorganism, which composition can be used to elicit an immune response in a mammal. The immune response can include a T cell response, a B cell response, or both a T cell and B cell response. The composition may serve to sensitize the mammal by the presentation of antigen in association with MHC molecules at the cell surface. In addition, antigen-specific T-lymphocytes or antibodies can be generated to allow for the future protection of an immunized host. An "immunogenic composition" may contain a live, attenuated, or killed/inactivated vaccine comprising a whole microorganism or an immunogenic portion derived therefrom that induces either a cell-mediated (T cell) immune response or an antibody-mediated (B cell) immune response, or both, and may protect the animal from one or more symptoms associated with infection by the microorganism, or may protect the animal from death due to the infection with the microorganism.

As used herein, the term "isolated" means that the referenced material is removed from its native environment. Thus, an isolated biological material can be free of some or all cellular components, i.e., components of the cells in which the native material occurs naturally (e.g., cytoplasmic or membrane component). A material is isolated if it is present in a cell extract or supernatant. An isolated protein may be associated with other proteins or nucleic acids, or both, with which it associates in the cell, or with cellular membranes if it is a membrane-associated protein. An isolated organelle, cell, or tissue is removed from the anatomical site in which it is found in an organism. An isolated material may be, but need not be, purified.

As used herein, the term "MHDCE" designates *Mycoplasma hyopneumoniae* DNA cell equivalents and is defined as a unit of measure used to determine the approximate number of *Mycoplasma hyopneumoniae* organisms present in a given sample.

The term "parenteral administration" as used herein means administration by some other means than through the gastrointestinal tract, particularly to the introduction of substances into an organism by intravenous, subcutaneous, intramuscular, or intramedullary injection, but also to other non-oral and non-nasal routes of administration such as intraperitoneal injection or topical application.

The term "polymorphic identity to a reference J strain" refers to similarity between the protein expression profile of one non-J strain *Mycoplasma hyopneumoniae* to a reference J strain of *Mycoplasma hyopneumoniae*. The polymorphic identity may be based on one or more characteristics of one or more proteins, including, but not limited to, for example, the amount or size of one or more proteins of the *Mycoplasma hyopneumoniae* microorganism under investigation, to the sedimentation rate of one or more proteins, or to changes in the physical or biochemical characteristics of one or more proteins. The term may also include similarity between the nucleotide sequences that encode any one or more proteins of one non-J strain of *Mycoplasma hyopneumoniae* and a reference J strain of *Mycoplasma hyopneumoniae* and includes any mutations in these sequences, including deletions or substitutions. The change in the nucleotide or amino acid sequence is one that allows for retention of the avirulent nature of the *Mycoplasma hyopneumoniae* organism. A wide variety of assays for observing perturbations in nucleotide and amino acid sequences are well known in the art. For example, the size and structure of nucleic acid or amino acid sequences are observed by the Northern, Southern, Western, SDS-PAGE ELISA profiling, PCR and DNA sequencing protocols as known to those skilled in the art (see, e.g. Calus, D. et al. Veterinary Microbiology, Vol. 120, Issues 3-4, Mar. 10, 2007, pages 284-291; Scarman, A L, et al. Microbiology (1997), Vol. 143: 663-673). In addition, other methods for observing perturbations in nucleotide and amino acid sequences such as single strand conformation polymorphism analysis are well known in the art (see, e.g., U.S. Pat. No. 5,382,510 issued 7 Sep. 1999, and U.S. Pat. No. 5,952,170 issued 17 Jan. 1995).

The term "purified" as used herein refers to material that has been isolated under conditions that reduce or eliminate the presence of unrelated materials, i.e., contaminants, including native materials from which the material is obtained. For example, a purified bacteria or protein is typically substantially free of host cell or culture components, including tissue culture or egg proteins, non-specific pathogens, and the like. As used herein, the term "substantially free" is used operationally, in the context of analytical testing of the material. Typically, purified material substantially free of contaminants is at least 50% pure; more typically at least 90% pure, and more typically still at least 99% pure. Purity can be evaluated by chromatography, gel electrophoresis, immunoassay, composition analysis, biological assay, and other methods known in the art. Methods for purification are well-known in the art. The term "substantially pure" indicates the highest degree of purity which can be achieved using conventional purification techniques known in the art.

A "reference strain" refers to a strain of microorganism, for example, *Mycoplasma hyopneumoniae*, that is obtained from a reliable source and which may be used as a control strain for which comparisons with other unestablished or unknown cultures may be compared. In the present invention, the reference strains of *Mycoplasma hyopneumoniae* may be avirulent J strains that are obtained from the American Type Culture Collection (ATCC) and are assigned ATCC accession numbers 25934 and 27715. In the present invention, these "reference strains" having ATCC accession numbers 25934 or 27715 have also been used to prepare the immunogenic compositions of the invention. In other certain embodiments of the present invention, the reference strains of *Mycoplasma hyopneumoniae* may be obtained from the American Type Culture Collection (ATCC) and are assigned ATCC accession numbers 25617 and 25095.

The term "SL-CD" refers to a sulpholipo-cyclodextrin that falls within the family of cyclodextrin adjuvants described in U.S. Pat. Nos. 6,610,310 and 6,165,995. Typically, SL-CD is formulated in a mixture with a metabolizable oil such as one or more unsaturated terpene hydrocarbons, for example, squalane and preferably with a non-ionic surfactant, such as polyoxyethylene sorbitan monooleate.

The term "SP-Oil" refers to an adjuvant that is an oil emulsion comprising: 1% to 3% vol/vol of polyoxyethylene-polyoxypropylene block copolymer; 2% to 6% vol/vol of squalane; 0.1% to 0.5% vol/vol of polyoxyethylene sorbitan monooleate; and a buffered salt solution.

The terms "vaccine" or "vaccine composition", which are used interchangeably, refer to pharmaceutical compositions comprising at least one immunogenic composition that induces an immune response in an animal. A vaccine or vaccine composition may protect the animal from disease or possible death due to an infection, and may or may not include one or more additional components that enhance the immunological activity of the active component. A vaccine or vaccine composition may additionally comprise further components typical to pharmaceutical compositions. A vaccine or vaccine composition may additionally comprise further components typical to vaccines or vaccine compositions, including, for example, an adjuvant or an immunomodulator. The immunogenically active component of a vaccine may comprise complete live organisms in either their original form, or as attenuated organisms in a modified live vaccine, or organisms inactivated by appropriate methods in a killed or inactivated vaccine, or subunit vaccines comprising one or more immunogenic components of the virus, or genetically engineered, mutated or cloned vaccines prepared by methods known to those skilled in the art. A vaccine or vaccine composition may comprise one or simultaneously more than one of the elements described above.

As used herein, "virulent" refers to the ability of a *Mycoplasma hyopneumoniae* strain to cause disease associated with *Mycoplasma hyopneumoniae* infection. Virulence can be evaluated by observing disease progression in the animal. An example of a "virulent" strain of *Mycoplasma hyopneumoniae* is that exemplified by the challenge strain of *Mycoplasma hyopneumoniae*, as described and used in the present invention. Other virulent strains of *Mycoplasma hyopneumoniae* are available from the American Type Culture Collection (ATCC), designated as Strain No. 25617 or 25095. The term "avirulent" refers to strains of *Mycoplasma hyopneumoniae* that are lacking in virulence. That is, avirulent strains, isolates, or constructs are non-pathogenic and are incapable of causing disease. As used herein the term "avirulent" is used synonymously with the term "non-virulent." Exemplified herein are compositions employing the *M. hyopneumoniae* avirulent live culture strain J (FCX3-Line 1, which is available from the American Type Culture Collection (ATCC) as Strain No. 27715). Another "avirulent" strain that is also available from the ATCC is designated as Strain No. 25934. The J strain designated as ATCC accession number 27715 was cloned from the parental J strain designated as ATCC accession number 25934, as described in the ATCC catalogue.

General Description

The present disclosure is based upon the discovery that one or two-dose regimens of a *Mycoplasma hyopneumoniae* composition, including an immunogenic composition or a vaccine composition, using one or more live avirulent *Mycoplasma hyopneumoniae*, such as, for example, strain J (FCX3-Line 1; ATCC Accession No. 27715) and one or more adjuvant, typically a biologically-acceptable adjuvant, are effective in protecting against and/or preventing or ameliorating disease associated with virulent *Mycoplasma hyopneumoniae* infection.

In one embodiment, other live avirulent strains of *Mycoplasma hyopneumoniae*, including, but not limited to, J strains, whose genome comprises a nucleic acid sequence having at least about 90% homology, or at least about 95% homology, or at least about 99% homology, with a reference J strain, are contemplated for use in the compositions and methods of the present invention.

In one embodiment, other live avirulent strains of *Mycoplasma hyopneumoniae*, including, but not limited to, J strains, which have at least about 70% polymorphic identity, or at least about 85% polymorphic identity, or at least about 95% polymorphic identity, to that of a reference J strain, are contemplated for use in the compositions and methods of the present invention.

The reference J strain may be selected from the *Mycoplasma hyopneumoniae* strains designated as ATCC accession number 25934 or 27715.

In one embodiment, the live avirulent J strain used in the compositions and methods of the present invention is a J strain designated as ATCC accession number 25934 or 27715.

In one embodiment, the live avirulent J strain used in the compositions and methods of the present invention is a J strain designated as ATCC accession number 27715.

It is also disclosed herein that compositions, including vaccine compositions, which employ one or more live avirulent *Mycoplasma hyopneumoniae* strain in further combination with Porcine Circovirus Type 1-Type 2 chimera modified live vaccine (cPCV1-2) (See U.S. Patent Publication number 2003/0170270 and number 2004/0253270) are also effective in protecting against and/or preventing or ameliorating disease associated with virulent *Mycoplasma hyopneumoniae* infection and/or virulent Porcine Circovirus infection.

In certain embodiments, the compositions of the invention further comprise one or more live bacteria, bacterin and/or one or more purified toxoid selected from the group consisting of *Haemophilus parasuis, Pasteurella multocida, Streptococcus suis, Actinobacillus pleuropneumoniae, Bordetella bronchiseptica, Salmonella choleraesuis, Erysipelothrix rhusiopathiae*, and leptospira bacteria.

In certain embodiments, the compositions of the invention further comprise one or more viral antigen selected from the group consisting of a swine influenza virus (SIV) antigen, a porcine reproductive and respiratory syndrome virus (PRRSV) antigen, raccoon poxvirus expressing PRRS or other antigens, TGEV expressing PRRS or other antigens, and a porcine circovirus (PCV) antigen.

Within certain embodiments, the present disclosure is described hereinafter with reference to protection against infection with a lung homogenate designated as LI-34 containing virulent *Mycoplasma hyopneumoniae* strain 11 (See J. Clin. Microbiol. 1999 March; 37(3):620-7. It is, however, contemplated that the compositions disclosed herein will be effective in protecting against and/or preventing or ameliorating disease or at least one symptom associated with the disease that are associated with a wide range of virulent *Mycoplasma hyopneumoniae* infections. Numerous virulent *Mycoplasma hyopneumoniae* isolates are known in the art and are available from various sources including the American Type Culture Collection, 12301 Parklawn Drive, Rockville, Md. 20852. Examples of these virulent strains include, but are not limited to, ATCC accession numbers 25095, 27714 and 25617.

Compositions, in particular immunogenic compositions or vaccine compositions, of the present disclosure may be prepared from lyophilized or freshly harvested cultures of live avirulent *Mycoplasma hyopneumoniae* by one or more methodology that is readily available in the art. Exemplified herein are compositions comprising the live avirulent *M. hyopneumoniae* strain J (FCX3-line 1), which is available as ATCC Number 27715 (a filtered and cloned 3 times isolate of ATCC Number 25934).

Live avirulent *Mycoplasma hyopneumoniae* may be cultured by the methodology described in U.S. Pat. Nos. 5,338,543 and 5,565,205, each of which is incorporated in its entirety herein. More specifically, *Mycoplasma hyopneumoniae* may be propagated in culture medium such as PPLO (Pleuropneumonia-like organism) complete medium (Difco; Becton Dickinson and Company, San Jose, Calif.). Growth of the organism is monitored by standard techniques such as determining color changing units (CCU), and harvested when a sufficiently high titer has been achieved. The stocks may be further concentrated or lyophilized by conventional methods before inclusion in the composition formulations. Other methods, such as those described in Thomas et al. *Agri-Practice* 7(5):26-30, may also be employed.

The conditions under which an isolate of *Mycoplasma hyopneumoniae* is grown may vary depending upon the precise composition of the medium and the specific isolate being grown. *Mycoplasma hyopneumoniae* isolates are typically grown from about 48 hours to about 144 hours, measured from the time of incubation to the time of harvest.

Depending upon the precise composition to be formulated, *Mycoplasma hyopneumoniae* may be concentrated by, for example, ultracentrifugation or ultrafiltration. The concentrated *Mycoplasma hyopneumoniae* may be recovered by methodology known in the art and may be mixed with a suitable physiologically acceptable carrier—typically an aqueous media such as, for example, saline, phosphate-buffered saline (PBS), minimal essential media (MEM), or MEM with HEPES buffer. It may then be further combined with an appropriate adjuvant to provide the desired concentration on a volume per volume basis (v/v). Compositions may further comprise one or more chelator, such as EDTA, typically at a concentration of about 0.05% to about 0.20% (w/v). Alternatively, the *Mycoplasma hyopneumoniae* strain to be used in the immunogenic or vaccine compositions may be concentrated as described above, or lyophilized and resuspended in an appropriate adjuvant at the desired concentration on a weight per volume (w/v) basis.

As indicated above, compositions, including immunogenic compositions or vaccine compositions, of the present disclosure generally comprise a live avirulent strain of *Mycoplasma hyopneumoniae* in combination with one or more adjuvant, typically a biologically acceptable adjuvant.

For one-dose administration, compositions may contain an amount of live avirulent *Mycoplasma pneunomoniae* corresponding to about $1 \times 10^8$ to about $3 \times 10^{11}$ MHDCE/ml. Alternatively, compositions may contain an amount of live avirulent *Mycoplasma pneunomoniae* corresponding to about $1 \times 10^9$ to about $3 \times 10^9$ MHDCE/ml. Compositions are formulated such that each administration dose will be between about one (1) ml and about five (5) ml, or between about two (2) ml, per animal for administration intramuscularly, subcutaneously, or intraperitoneally and between about one (1) and about ten (10) ml, or between about two (2) and about five (5) ml, for administration orally or intranasally.

For two-dose administration, compositions typically contain an amount of live avirulent *Mycoplasma pneumomoniae* of about $1 \times 10^8$ to about $3 \times 10^{11}$ MHDCE/ml, more typically about $1 \times 10^9$ to about $3 \times 10^9$ MHDCE/ml. In certain embodiments for two dose administration, compositions may contain an amount of live avirulent *Mycoplasma pneumomoniae* containing about $10^3$ CFU/ML TO $10^{11}$ CFU/ML. Compositions are formulated such that each administration dose will be between about one (1) ml and about five (5) ml, preferably about two (2) ml per animal for administration intramuscularly, subcutaneously, or intraperitoneally and between about one (1) and about ten (10) ml, typically between about two (2) and about five (5) ml for administration orally or intranasally.

The adjuvant mixture for use in the immunogenic compositions and vaccine compositions of the present disclosure enhances the immune response by stimulating cell mediated and/or local (secretory IgA) immune responses. The biologically acceptable adjuvant may, for example, be one or more adjuvant selected from the group consisting of SP-Oil, SL-CD, an acrylic acid polymer (such as Carbopol), and a mixture of a metabolizable oil such as one or more unsaturated terpene hydrocarbon(s), for example squalene or squalane, and a polyoxyethylene-polypropylene block copolymer such as Pluronic®. Adjuvants may be further selected from cytokines, such as IL-12 and IL-18; aluminum hydroxide; ethylene maleic acid copolymer; DEAE dextran; mycobacteria cell wall derived adjuvant; and the like.

The concentration of adjuvant employed in the compositions described herein will depend upon the nature of the adjuvant. Adjuvants are typically present in the compositions described herein at a final concentration of about 1-50% and more typically at a final concentration of about 10%, 15%, 20%, 25%, or 30%. The concentration of the antigen in the adjuvant may be prepared on a weight per volume basis (w/v) or on a volume per volume (v/v) basis. For example, the antigen to be delivered in the compositions of the invention may be prepared in a lyophilized form, followed by reconstitution in the adjuvant directly to result in the specified concentrations on a weight per volume basis. Alternatively, the antigen may first be reconstituted in an appropriate diluent (for example, a buffer) to which is then added an adjuvant in a volume sufficient to result in the final desired concentration of both antigen and adjuvant on a volume per volume basis, as described above.

In certain embodiments, an adjuvant may be administered with the antigen/immunogen as a single composition, or can be administered before, concurrent with, or after administration of the antigen/immunogen.

The choice of the adjuvant depends on the stability of the antigen/immunogen containing the adjuvant, the route of administration, the dosing schedule, the efficacy of the adjuvant for the species being vaccinated and must also be one approved for use in animals or humans by the pertinent regulatory bodies.

In compositions comprising SP-Oil, the adjuvant is typically present at between about 1% and about 25% (v/v), more typically between about 5% and about 15% (v/v) such as, for example, at about 10% (v/v); in compositions comprising an acrylic acid polymer and a mixture of a metabolizable oil that comprises one or more terpene hydrocarbon(s) and a polyoxyethylene-polypropylene block copolymer, the ratio of acrylic acid polymer to metabolizable oil/polyoxyethylene-polypropylene block copolymer mixture is typically in a ratio of between about 1:25 and about 1:50. A metabolizable oil, a polyoxyethylene-polypropylene block copolymer, and an acrylic acid polymer may be employed in the form of an oil in water emulsion wherein acrylic acid polymers are typically employed at a concentration of between about 0.5 g/l and about 10 g/l; metabolizable oils are typically employed at a concentration of between about 2 ml/l and about 6 ml/l; and polyoxyethylene-propylene block copolymers are typically employed at a concentration of between about 1 ml/l and about 3 ml/l.

Exemplary suitable adjuvant mixtures include, but are not limited to, mixtures of one or more acrylic acid polymer(s) with a mixture of metabolizable oil, for example an unsaturated terpene hydrocarbon or a hydrogenation product thereof, preferably squalane (2,3,10,15,19,23-hexamethyltetracosane) or squalene, and a polyoxyethylene-polyoxypropylene block copolymer. Such an acrylic acid polymer may be a homopolymer or a copolymer.

Acrylic acid polymers are typically carbomers. Carbomers are commercially available under the trade name Carbopol and are described, for example, in U.S. Pat. Nos. 2,909,462 and 3,790,665, each of which is incorporated herein by reference.

The polyoxyethylene-polyoxypropylene block copolymers are surfactants, typically liquid surfactants, which aid in suspending solid and liquid components. Surfactants are commercially available as polymers under the trade name Pluronic®. The surfactant poloxamer 401 is commercially available under the trade name Pluronic® L121.

The adjuvant mixture may comprise a metabolizable oil, an acrylic acid polymer and a polyoxyethylene-polyoxypropylene block copolymer formulated as an emulsion in an aqueous medium. Within certain embodiments, the adjuvant mixture may include a metabolizable oil and polyoxyethylene-polyoxypropylene block copolymer such as a mixture of squalane and Pluronic® L121 (poloxamer 401) which may be present in an amount of between about 50 ml/l and about 100 ml/l and the carboxymethylene polymer may be Carbopol 934P (Carbamer 934P), which may be present in amount of about 2 ml/l.

Preferred acrylic acid polymers are those marketed by B. F Goodrich as Carbopol 934 P NF and 941 NF, which are polymers of acrylic acid cross-linked with polyallylsucrose and which have the chemical formula $(CH_2CHOOOH)_n$. These polymers form aqueous gels which suitably formulate with aqueous carriers. Polyoxyethylene-polypropylene block copolymers may be the nonionic surfactants marketed by BASF as Pluronic® L121, L61, L81 or L101.

Within certain embodiments, compositions disclosed herein may employ, in further combination, one or more other live bacteria, bacterin, toxoid, and/or viral antigen. Thus, within certain aspects of these embodiments, the adjuvanted live avirulent M. hyopneumoniae composition may comprise an immunizing amount of a live avirulent Mycoplasma hyopneumoniae and one or more biologically acceptable adjuvant in further combination with (a) one or more live bacteria such as, for example, Haemophilus parasuis, Pasteurella multocida, Streptococcus suis, Actinobacillus pleuropneumoniae, Bordetella bronchiseptica, Salmonella choleraesuis, Erysipelothrix rhusiopathiae, and leptospira bacteria; (b) one or more bacterin; (c) one or more purified toxoid from one or more pathogens such as, for example, Haemophilus parasuis, Pasteurella multocida, Streptococcus suis, Actinobacillus pleuropneumoniae, Bordetella bronchiseptica, Salmonella choleraesuis, Erysipelothrix rhusiopathiae, and leptospira bacteria; and/or (d) one or more viral antigen wherein the virus is selected from the group consisting of swine influenza virus (SIV; such as SIV strains H1N1, H1N2, and H3N2), porcine reproductive and respiratory syndrome virus (PRRSV), raccoon poxvirus expressing PRRS and/or other antigens, TGEV expressing PRRS and/or other antigens, and porcine circovirus (PCV). Exemplified herein are compositions, including vaccine compositions, which employ one or more live avirulent Mycoplasma hyopneumoniae strain in further combination with porcine circovirus Type 1-Type 2 chimera modified live vaccine (cPCV1-2) (See U.S. Patent Publications 2003/0170270 and 2004/0253270).

Within these or alternative embodiments, compositions, including vaccine compositions, may additionally or optionally include a preservative such as, for example, thimerosol and/or EDTA. See, also, U.S. Patent Publication Nos. 2002/0131980 and 2003/0017171, each of which is herein incorporated by reference in its entirety.

The concentration of such other live bacteria, bacterin, toxoid, and/or viral antigen employed in the compositions described herein will depend upon the nature of the bacterin, toxoid, and/or viral antigen and are typically present in the compositions described herein at a final concentration of between about $0.5 \times 10^5$ to $0.5 \times 10^{10}$ per ml. Alternatively, the bacteria are present in a final concentration of between about $0.5 \times 10^6$ to $0.5 \times 10^9$ per ml or between about $0.5 \times 10^7$ to $0.5 \times 10^8$ per ml.

Compositions of the present disclosure will find utility in methods for protecting an animal against disease caused by Mycoplasma hyopneumoniae and/or for preventing or ameliorating an outbreak of such disease among animal populations by administration an adjuvanted live avirulent Mycoplasma hyopneumoniae composition as described herein. Compositions described herein may also be advantageously employed in methods for enhancing in an animal an immune response, such as a cell-mediated and/or humoral immune response, to Mycoplasma hyopneumoniae. Such methods comprise the steps of administering to an animal, typically swine, in one or two doses, a composition comprising one or more adjuvanted live avirulent Mycoplasma hyopneumoniae strain. Depending upon the precise application contemplated, compositions may be administered intramuscularly, subcutaneously, orally, by aerosol, or intranasally.

According to the methods of the present disclosure, a desirable dosage regimen involves administration of one or more doses of desired vaccine composition to the pig. Typically, where two doses are administered to the animal, the doses are administered between about one (1) week apart and about four (4) weeks apart, more typically between about two (2) weeks apart and about three (3) weeks apart.

EXAMPLES

The present disclosure will be better understood by reference to the following non-limiting examples:

Example 1

Preparation of an M. Hyopneumoniae Avirulent Adjuvanted Live Vaccine

This Example discloses the preparation of an exemplary adjuvanted live avirulent M. hyopneumoniae composition according to the present disclosure.

Mycoplasma hyopneumoniae may be obtained from any number of readily available sources. In one embodiment described herein, M. hyopneumoniae avirulent live culture strain J (FCX3-Line 1), was obtained from the American Type Culture Collection (ATCC; Manassas, Va.) as ATCC Strain No. 27715. Any other avirulent strain of M. hyopneumoniae may be used for preparation of the compositions, such as, for example, the parent J strain designated as ATCC accession number 25934. In certain other embodiments, it is envisioned that any live virulent strain of Mycoplasma pneumoniae, may be modulated, attenuated or mutated until the culture is established to be avirulent, as determined by in vitro or in vivo testing, using procedures known to those skilled in the art. The full genomic sequence of the ATCC 25934 J strain has been published by Vasconcelos et al (J. Bacteriol. (2005), 187(16): 5568-5577) and has been assigned GenBank accession number AE017243. Several of the sequences associated with ATCC strain 25934 may be found in PubMed and have GenBank accession numbers AY737012 (16S ribosomal RNA gene), AY512905 (adhesin gene, AF013714 (prolipoprotein p65 gene), U02538 (23S rRNA gene) and U02537 multidrug resistance protein homolog genes).

Each vaccine composition for the bactericidal assay was prepared from one lyophilized vial of a M. hyopneumoniae culture rehydrated with 20 ml of normal saline. Vaccine compositions included a combination of 5 ml of the rehydrated culture and adjuvant sufficient to acquire the specified adjuvant concentration in a final volume of 10 ml. A control composition was also prepared by combining 5 ml of rehydrated culture with 5 ml of normal saline. All compositions were mixed for 5 minutes prior to sampling. Samples were taken from all compositions at 5 minutes (0 hour), 3 hours, and 7 hours after blending. The viability of each vaccine was determined by Colony Forming Units (CFU) at each sampling point (see Table 1).

TABLE 1

| | CFU/ml | | | MPN/ml | | |
|---|---|---|---|---|---|---|
| Adjuvant | 0 hour | 3 hour | 7 hour | 0 hour | 3 hour | 7 hour |
| 30% SL-CD | 1.44E+07 | 0 | 0 | 1.15E+07 | 0 | 0 |
| 10% SL-CD | 1.48E+07 | 6.40E+05 | 5.2E+03 | 2.87E+07 | 8.42E+05 | 0.00E+00 |
| Control | 8.30E+07 | 1.06E+08 | 9.00E+07 | 3.62E+07 | 6.22E+07 | 3.62E+07 |
| 5% SP-Oil | 9.46E+07 | 7.60E+07 | 2.55E+07 | 4.67E+07 | 9.40E+07 | 6.22E+06 |
| 5% SP-Oil/0.2% | 1.50E+08 | 5.61E+07 | 4.53E+07 | 4.27E+08 | 7.74E+07 | 2.84E+06 |
| Control | 2.17E+08 | 1.41E+08 | 9.86E+07 | 1.91E+08 | 8.42E+07 | 4.67E+07 |
| 10% SP oil | 1.09E+07 | 1.07E+07 | 7.13E+06 | 3.40E+06 | 7.74E+06 | 3.62E+06 |
| Control | 3.50E+07 | 4.75E+07 | 7.20E+07 | 1.03E+07 | 8.42E+07 | 3.14E+07 |
| 10% Sp-oil + 0.2% carbopol | 5.20E+07 | 1.30E+07 | 8.13E+06 | 5.50E+07 | 1.91E+07 | 2.26E+06 |
| 0.2% carbopol | 6.80E+07 | 6.67E+07 | 6.60E+07 | 1.63E+08 | 1.38E+08 | 4.45E+07 |
| control | 2.90E+07 | no test | 5.54E+07 | 1.23E+08 | No test | 1.38E+07 |

The average viability of the stock culture was determined by averaging all the control viabilities at 0 hour, average $9.09\times10^7$ CFU/ml. In comparison, the most-probable number (MPN) was determined for the stock cultures resulting in $1.85\times10^8$ MPN/ml. Vaccine blending and vaccination typically takes less than 3 hours; therefore when looking at the bactericidal effect of adjuvants, the 3 hour time point is the most important. The trend for SP-Oil at 5% and 10% at the 3-hour sampling compared to the control is a 2-fold difference and 4-fold difference, respectively.

Vaccine A was prepared by rehydrating vials of lyophilized culture with diluent containing 10% (v/v) SP-Oil final concentration. The placebo vaccine was sterile normal saline.

Example 2

In vivo Efficacy of *M. hyopneumoniae* Avirulent Adjuvanted Live Vaccines in Pigs This Example demonstrates the in vivo efficacy of exemplary adjuvanted live avirulent *M. hyopneumoniae* vaccine compositions.

A total of 30, four to six week-old pigs were acquired from Fort Dodge Animal Health's SPF herd in Charles City, Iowa. Pigs were maintained on feed without antibiotics or growth promotants and given water and food ad libitum. Animals receiving vaccine compositions and control compositions were housed in different rooms and all pigs were maintained under similar conditions during vaccination, monitoring, and challenge periods.

The 30 pigs were randomly assigned into three (3) groups as follows: One (1) group received a vaccine composition, one (1) group received a placebo, and one (1) group served as an environmental control. Pigs were grouped as shown in Table 2.

TABLE 2

| Group | Total# of | Vaccine | # Pigs |
|---|---|---|---|
| 1 | 13 | A | 13 |
| 2 | 12 | placebo | 12 |
| 3 | 5 | N/A | N/A |

Four to six week-old pigs were vaccinated intramuscularly with a 2 ml dose of the appropriate vaccine. Group 1 was administered vaccine A, group 2 was administered the placebo. Pigs from group 3 were not vaccinated or challenged and served as environmental controls. Pigs in group 1 were vaccinated twice, two weeks apart. Two weeks after the second vaccination, all pigs in groups 1 and 2 were challenged with a lung homogenate (LI-34) containing a virulent strain of *M. hyopneumoniae* Strain 11 (J. Clin. Microbiol., 1999 March; 37(3):620-7) Four weeks after challenge, all pigs in groups 1-3 were necropsied and lung lesions were evaluated.

Preparation of Lung Homogenate (LI-34) for *M. hyopneumoniae* Challenge Strain

Seven cross-bred pigs were procured from Spring Prairie Colony Farms (Genetipork) and were inoculated intratracheally with 10 ml of a 1:30 dilution of a 10% crude lung homogenate (LI31) of *M. hyopneumoniae* strain 11. The LI31 crude lung homogenate had been produced by passaging lung homogenate containing *M. hyopneumoniae* in specific pathogen free pigs and harvesting the resulting pneumonic lungs at early mid-stage of the disease. The lung homogenates were stored at −70° C. until needed.

Serum was collected upon arrival and at necropsy from all pigs and was evaluated at the ISU Veterinary Diagnostic Laboratory (ISU-VDL) for evidence of antibodies to TGE (PRCV), SW and PRV. In addition, ELISA's for PRRSV and *M. hyopneumaniae* antibodies were performed and all samples were negative for all of the above respiratory pathogens.

All pigs were necropsied. Pentobarbital was used to induce deep anesthesia of pigs prior to exsanguination. The ventral chest wall was opened and areas of pneumonic lesions typical of *M. hyopneumoniae* were removed aseptically and placed individually in sterile containers.

A small portion of each lung was ground and checked for purity on blood agar plates, beef heart infusion broth, and Friis media. Tube dilutions were performed in Friis media to titrate out the *M. hyopneumoniae*. Tie remaining lung pieces were frozen in 50 ml centrifuge tubes at −70° C. until the results of the bacteriology and mycoplasma isolation were known. Lung lobes from 3 of the 7 pigs were used to produce the *M. hyopneumoniae* lung inoculum.

Lobe chunks were thawed from pigs #329, 331, and 332 and ground in Friis media containing no antibiotics. Purity of lung inoculum was confirmed by culture on beef heart infusion, blood agar and Friis media. Only micrococci consistent with environmental contamination were found on one plate. The lung inoculum was titrated for *M. hyopneumoniae* levels and found to contain approximately $10^7$ CCU/ml. An aliquot was submitted to ISU-VDL for virus isolation assays for SN, EMS, enterovirus, HEV, PRCV, PRRSV, Pseudorabies, TGE, parvovirus, and rotavirus. The results of all assays were negative. Final volume of ground lung inoculum (labeled LI 34) was 1780 ml from 178.1 grams of lung tissue. This was aliquoted into 100×5 ml and 110×10 ml volumes.

In the second phase of the study, 9 pigs were used in the determination of the concentration of lung inoculum required to induce an average of 8% pneumonic-lung lesions in a minimum of 80% of the pigs. All pigs were challenged with the L134 *M. hyopneumoniae* strain 11 intratracheally on as previously described. Challenge dilutions included 1:30, 1:100, and 1:500.

The pigs were necropsied. Pentobarbital was used to induce deep anesthesia prior to exsanguination. The lungs were removed and lung lesions sketched on standard lung diaphrams. Serum was collected from all pigs and was assayed by ELISA for antibodies to *M. hyopneumoniae*. All pigs were either low positive or seronegative for *M. hyopneumoniae* suggesting no previous exposure to *M. hyopneumoniae* prior to arrival. Tracheal swabs were collected aseptically from all pigs. *Pasteurella multocida* and *Haemophilus parasuis* were isolated from 4 and 3 pigs respectively. *M. hyopneumoniae* was isolated from all challenged pigs. Lung sketches were evaluated with a Zeiss Image analysis system to determine the percentage of pneumonic lung lesions.

Conclusions

The challenge of the pigs was successful and a dilution of 1:100 would be the optimal dilution to use. The average percentage of pneumonia induced was 10.17+/−6.6, which is higher than normal, however this may be attributed to the presence of *Pasteurella multocida* and/or *parasuis* in the pigs. In addition, 100% of the pigs inoculated with the challenge inoculum had significant lung lesions. Overall, these results are fairly typical of what we observe in our studies of *M. hyopneumoniae*, in that if there are other pathogens present, there is an increase in pneumonia. This may be due to the interaction between the pathogens and the immune system. We produced 1,600 ml of *M. hyopneumoniae* lung inoculum for use in experimental challenge experiments. The inoculum will produce at least 8% or higher pneumonic lung lesions in a minimum of 80% of inoculated pigs when used at a 1:100 dilution intratracheally.

The vaccine was titrated prior to the day of vaccination and bactericidal assays were conducted to determine the appropriate adjuvant systems to be used (see Example 1). From these data, 10% SP-Oil adjuvant system was chosen for further study. The average viability per vial of stock culture was $3.64\times10^{9}$ CFU/Bottle.

On the day of the first administration, vaccine compositions were prepared as follows: Vaccine A—each of three vials of avirulent *M. hyopneumoniae* lyophilized culture was rehydrated with 10 ml of 10% SP-Oil diluent. The three vials of vaccine composition for each diluent type were pooled and allowed to mix for 20 minutes on a stir plate with stir bar. The placebo was normal saline aliquoted into a sterile bottle for administration. The compositions remained on ice during the course of vaccination for 2 hours.

On the day of the second administration, vaccine compositions were prepared as follows: Vaccine A—each of three vials of avirulent *M. hyopneumoniae* lyophilized culture was rehydrated with 10 ml of 10% SP-Oil Diluent. The three vials of rehydrated culture for each diluent type were pooled and allowed to mix for 20 minutes on a stir plate with stir bar. The placebo was normal saline aliquoted into a sterile bottle for administration. The compositions remained on ice during the course of vaccination for 2 hours.

The concentration of viable *M. hyopneumoniae* in each composition was determined before and after administration. Viability was evaluated by determining Colony Forming Units (CFU/ml). A vial of lyophilized stock culture was rehydrated with 10 ml of normal saline, allowed to mix for 20 minutes, and served as a control for the viability assay. Since the first control viability was lower than the test vaccine viability, during the second administration, two vials were rehydrated and pooled to serve as the control (see Table 3 for test vaccine viabilities and control viabilities).

TABLE 3

| Vaccine | First Vaccination CFU/mL | Second Vaccination CFU/mL |
|---|---|---|
| Group 1: Adjuvant 10% SP-Oil | 2.79E+08 | 2.27E+08 |
| Viability Control | 1.29E+08 | 2.69E+08 |

All pigs were observed daily for temperatures and clinical symptoms starting two days prior to each administration and continued for seven days after each administration. Pigs were observed for clinical symptoms, which included, but were not limited to, coughing, sneezing, nasal discharge, depression, inappetance, and labored breathing.

Fourteen days after the second administration, pigs in group 1 were challenged trans-tracheally with a virulent strain of *M. hyopneumoniae.*

On the day of challenge, a virulent *M. hyopneumoniae* challenge stock of frozen (−70° C.) lung homogenate (LI-34), was thawed rapidly under warm water and diluted (1:100 dilution) with. Pigs were sedated with a mixture of Xylazine-Ketamine-Telazol™ consisting of 50 mg/ml Xylazine, 50 mg/ml Ketamine, and 100 mg/ml Telazol. Each pig was given 10 ml of the challenge material trans-tracheally. To ensure needle placement, air was drawn into the syringe prior to administration of the challenge material. All pigs were observed daily for clinical symptoms post-challenge.

Pigs were bled for serum on days 0, 14, 28, and 56. Serological response of the pigs to *M. hyopneumoniae* challenge was determined by ELISA. Four weeks after challenge, all pigs from groups 1-3 were euthanized and lungs were removed. Test groups were blinded and scored for gross lung lesions. Atypical *M. hyopneumoniae* lesions were formalin fixed for subsequent histopathological evaluation. Swab samples from affected lung were collected for bacterial isolation.

The average lung lesion score for pigs in group 1 (5.9%) was approximately 50% less than the placebo group (14.8%). When the statistical analysis was adjusted for litter, the mitigated fraction for group 1 was 69.2% reduction in severity of lung lesions when compared to controls. These data are summarized in Table 4. All of the pigs were sero-negative on the day of first administration indicating that the pigs were susceptible to *M. hyopneumoniae* infection. With the exception of one (1) pig in the SP-Oil group, pigs did not sero-convert after the first vaccination. All pigs receiving the SP-Oil adjuvanted vaccine composition developed an antibody response after the second shot. Serological response demonstrates that an immune response to *M. hyopneumoniae* was elicited. (See Table 9. for serology results)

TABLE 4

| Vaccine | Description | Mitigated Fraction Reduction in Lesions Compared to Control | Mitigated Fraction Reduction Lower Confidence Level |
|---|---|---|---|
| Vaccine A | Avirulent *M. hyopneumoniae* live with 10% SP-Oil | 69.2 | 40.2 |
| Control | Placebo | NA | NA |

The statistical analysis of the data must meet the criteria for the mitigated fraction (<50% with lower confidence level >30%) for reduction in lung lesions for a vaccine to be considered efficacious for M. hyopneumoniae. In total, these data demonstrate that a live avirulent adjuvanted M. hyopneumoniae may be advantageously employed for eliciting a protective immune response when administered in vivo to an animal.

While the invention has been described in each of its various embodiments, it is expected that certain modifications thereto may be undertaken and effected by the person skilled in the art without departing from the true spirit and scope of the invention, as set forth in the previous description and as further embodied in the following claims. The present disclosure is not to be limited in scope by the specific embodiments described herein. Indeed, various modifications of the invention in addition to those described herein will become apparent to those skilled in the art from the foregoing description and the accompanying figures. Such modifications are intended to fall within the scope of the appended claims. It is further to be understood that all values are approximate, and are provided for description. All patents and patent applications cited herein are hereby incorporated herein by reference in their entireties.

Example 3

Preliminary Immunogenicity Study of the
*Mycoplasma hyopneumoniae* Fraction of
*Mycoplasma hyopneumoniae* Live Avirulent
Strain-Porcine Circovirus Type 1-Type 2 Chimera
Modified Live Combination Vaccine in 3 to 4 Week
Old Pigs Combination Vaccine in 3-4 Week Old Pigs This Example discloses the efficacy of a combination vaccine comprising an adjuvanted live avirulent *Mycoplasma hyopneumoniae* J (FCX3-line1) strain and a Porcine Circovirus (PCV) Type 1-Type 2 Chimera live vaccine (cPCV1-2; see U.S. Pat. Nos. 7,279,166 and 7,276,353) when administered intramuscularly (IM) or intranasally (IN) in 3-4 week old pigs. This combination vaccine (PCV/MH) is suitable for use for the vaccination of healthy swine as an aid in the prevention and/or to reduce the severity of disease caused by M. hyopneumoniae and Porcine Circovirus.

The targeted test vaccine should contain about 4.0 $Log_{10}$ $FAID_{50}$/dose of cPCV1-2 modified live virus and $4 \times 10^8$ CFU/dose of M. hyopneumoniae J strain (see King et al, Journal of Comparative Medicine and Vet. Science, 29: 85-89 (1965) and U.S. Pat. No. 4,824,785 for the FAID method). The vaccine was adjuvanted to contain 10% (v/v) SP-Oil final concentration. The placebo vaccine was sterile Normal Saline.

A total of 66 3-4 week-old pigs were employed in this study. 16 pigs were administered 2 ml of PCV/MH live vaccine intramuscularly once and challenged (Group 1); 15 pigs were administered 2 ml of PCV/MH live vaccine intramuscularly twice (two weeks apart) and challenged (Group 2); 15 pigs were administered 2 ml (1 ml/nostril) of PCV/MH live vaccine intranasally twice (two weeks apart) and challenged (Group 3); 15 pigs were not administered the PCV/MH live vaccine and challenged (Group 4); and 5 pigs served as environmental controls (Group 5).

The vaccine used in the study disclosed herein was a combination of MH lyophilized live antigen (lot#1744-56) and diluent containing PCV (LotC108-56) live vaccine. On the day of vaccination, the lyophilized live MH cake was rehydrated with diluent containing PCV live virus (4.0 $Log_{10}FAID_{50}$/mL adjuvanted with 10% SP Oil). Final vaccine was assigned Lot# 2315-30. Viability for the MH fraction was determined before and after vaccination, $3.18 \times 10^8$ CFU/mL (before) and $1.65 \times 10^8$ CFU/mL (after), respectively. The PCV titer for the vaccine pre and post vaccination was 4.09 $Log_{10}$ $FAID_{50}$ and 3.7 $Log_{10}$ $FAID_{50}$, respectively. The vaccine for second vaccination was prepared as above and assigned Lot# 2315-32. Viability for the MH fraction was $1.24 \times 10^8$ CFU/mL and $1.5 \times 10^8$ CFU/mL pre and post vaccination respectively. The viability for the PCV fraction was 4.36 $Log_{10}$ $FAID_{50}$ and 3.83 $Log_{10}$ $FAID_{50}$, respectively.

The pigs were observed for 7 days following vaccination for any adverse reactions to the vaccine. Three pigs died during the post vaccination observation period due to non-MH or PCV related causes. A summary of the clinical observations from the post vaccination period is found in Table 5.

TABLE 5

| Group | # of pigs | Treatment | Route | Dosage | Observation after vaccination |
|---|---|---|---|---|---|
| 1 | 16 | Vaccination | IM | 1 dose | One pig was noted to have elevated temp (105.1-106.2° F.) for 7 consecutive days starting on fifteen days post first vaccination. Another pig was noted to have an elevated temp, inappetance and depression for 4 consecutive days starting 18 days post first vaccination. |
| 2 | 15 | Vaccination | IM | 2 doses | One pig died the day before second vaccination due to possible HPS or *S. suis* infection. Clinical signs of depression and thin were noted prior to vaccination. One pig had 3 consecutive days of elevated temp (105.0-106.7° F.) starting 5 days post first vaccination. |
| 3 | 15 | Vaccination | IN | 2 doses | Two days prior to second vaccination one pig died due to intestinal perforation. Two pigs had swollen joints and coughing for 8 consecutive days, which had originated prior to first vaccination. Two other pigs one day prior to second vaccination was noted to have swollen hocks for 7 |

TABLE 5-continued

| Group | # of pigs | Treatment | Route | Dosage | Observation after vaccination |
|---|---|---|---|---|---|
| | | | | | consecutive days in which one resulted in an abscess, the other healed. |
| 4 | 15 | Saline | IM | 2 doses | One pig was noted to have swollen hocks throughout the study noted prior to first vaccination. Another pig also had swollen hocks for several days during the study. One pig had two days of elevated temp. for two consecutive days 105.1° F. and 106.5° F. starting 6 days after second vaccination. |
| 5 | 5 | No Vaccination | NA | NA | Housed with group 4 pigs during vaccination. No adverse reactions noted. |

NA: Not applicable
IN: intranasal
IM: intramuscular

All pigs in Groups 1-4 were challenged with a virulent strain of *M. hyopneumoniae* (pig lung homogenate containing virulent MH (LI-34)). Pigs from Group 1 were challenged four weeks after first vaccination. Pigs in Groups 24 were challenged two weeks after second vaccination. At four weeks after challenge, all pigs in Groups 1-5 were necropsied and lung lesions were evaluated.

The vaccine was titrated prior to the day of vaccination. Lyophilized culture of avirulent *M. hyopneumoniae* was rehydrated on the day of vaccination. The concentration of *M. hyopneumoniae* organisms in the vaccine was approximately $2 \times 10^8$ CFU/ml. A sample of vaccine was retained and a viability assay performed before and after vaccination to confirm actual CFU/ml. The vaccine was held on ice during the course of vaccination.

All pigs were observed daily for temperatures and clinical signs starting two days prior to each vaccination continuing for seven days after each vaccination. Pigs were observed for clinical symptoms, which included, but were not limited to, coughing, sneezing, nasal discharge, depression, inappetance, and labored breathing. 14 days after the second vaccination, pigs in Groups 1-4 were challenged trans-tracheally with a virulent strain of *M. hyopneumoniae*.

On the day of challenge, the virulent *M. hyopneumoniae* challenge stock, a frozen (−70° C.) lung homogenate (LI-34) was thawed rapidly under warm water and diluted (1:100 dilution) using sterile *M. hyopneumoniae* growth medium. Pigs were sedated with a mixture of Xylazine-Ketamine-Telazol™ comprising 50 mg/ml Xylazine, 50 mg/ml Ketamine and 100 mg/ml Telazol. Each pig was given 10 ml of the challenge material transtracheally. To ensure needle placement, air was drawn into the syringe prior to administration of the challenge material.

All pigs were observed grossly for clinical signs after challenge. The observation was conducted daily for any abnormal clinical sign. Pigs were bled for serum (no more than 13 ml whole blood) on day 0, 14, 28, and 56 of the study. Serum was collected, but not evaluated. ELISA may be conducted to evaluate serological response of the pigs using the serum collected during the study period in the future.

Four weeks after challenge, all pigs from Groups 1-5 were euthanized and lungs were removed. Atypical *M. hyopneumoniae* lesions were formalin fixed and the samples were examined for histopathology. Swab samples from affected lung were collected for bacterial isolation. Pigs that died after challenge were necropsied and samples collected as described above. Vaccine efficacy was defined as a combined average lung lesion score of the vaccinates that was 50% less than the combined average lung lesion score of the controls.

On the day of necropsy all pigs were euthanized, lung lesions scored and swabbed for bacterial isolation. Bacteria isolated from the swabs consisted of the following: *Staphylococcus heamolyticus, Streptococcus suis* (P322), *Staphylococcus epidermis, A. pyogenes, aerococus* species, *S. uberis, Bordetella bronchiseptica* (P344) and Microbacterium. The statistical analysis for the Lung lesion scores is in Table 6.

TABLE 6

| Group | Protection ratio | MF litter adjusted | MF Lower confidence level | Litter adjusted percent lung lesion score | LCL lung lesion score | Standard deviation of lung lesion | Mean percentile for lesions |
|---|---|---|---|---|---|---|---|
| Vaccinate IM single dose | 1/15 | 52.9% | 19.6% | 6.30% | 3.86% | 4.41 | 0.37 |
| Vaccinate IM double dose | 3/15 | 63.8% | 33.8% | 5.03% | 2.39% | 4.59 | 0.31 |
| Vaccinate IN double dose | 0/14 | −8.6% | −51.8% | 12.86% | 8.59% | 7.38 | 0.65 |
| Control | 0/15 | NA | NA | 11.46% | 8.41% | 5.5 | 0.62 |

LCL = Lower Confidence Level
MF = Mitigated Fraction

The statistical analysis of the data met the criteria for the mitigated fraction (<50%, with LCL >30%) for reduction in lung lesions. This example demonstrates (a) the efficacy of the MH/PCV vaccine for the MH fraction with two 2 mL doses administered IM, at $3.18 \times 10^8$ CFU/mL and (b) the safety of the MH/PCV vaccine due to lack of clinical signs related to MH or PCV following vaccination.

Example 4

Immunogenicity Study of the *Mycoplasma hyopneumoniae* Fraction of *Mycoplasma hyopneumoniae* Live Avirulent Strain-Porcine Circovirus Type 1-Type 2 Chimera Modified Live Combination Vaccine in 3-4 Week Old Pigs This Example discloses an immunogenicity study which supports the results from the study presented in Example 3 and confirms the efficacy of the *M. hyopneumoniae* fraction of *Mycoplasma hyopneumoniae* live avirulent strain-Porcine Circovirus Type 1-Type 2 (cPCV1-2) chimera modified live vaccine combined vaccine (MH/PCV) when administered intramuscularly. The MH/PCV vaccine disclosed herein may be suitably employed for the vaccination of healthy swine as an aid in preventing and/or minimizing the severity of disease caused by *M. hyopneumoniae* and Porcine Circovirus.

The pigs used in the present study were sero-negative to *M. hyopneumoniae* as determined by ELISA.

A total of 79, three to four week-old pigs were randomized into four groups. 24 pigs, Group 1, were vaccinated with a single dose of the combination PCV/MH live vaccine. 24 pigs, Group 2, were vaccinated with the combination vaccine twice two weeks apart. 24 pigs, Group 3, were vaccinated with normal saline twice two weeks apart to serve as challenge controls. All vaccines were administered intramuscularly. Four pigs, Group 4, were neither vaccinated nor challenged and served as environmental controls.

The vaccine used in the study was a combination of MH lyophilized live antigen (Lot1744-66) and diluent containing PCV (cPCV1-2 LotC108-56) live vaccine. On the day of vaccination, the lyophilized live MH cake was rehydrated with diluent containing PCV live virus (3.5 $Log_{10}FAID_{50}$/mL adjuvanted with 10% SP Oil). Final vaccine was given Lot2315-40. Viability for the MH fraction was determined before and after vaccination, $2.09 \times 10^8$ CFU/mL and $1.56 \times 10^8$ CFU/mL respectively. The placebo vaccine was sterile normal saline.

The vaccine for second vaccination was prepared as above and given Lot# 2315-42. Viability for the MH fraction was $1.05 \times 10^8$ CFU/mL and $6.72 \times 10^7$ CFU/mL pre and post vaccination respectively. The viability for the PCV fraction diluent was 3.44 $Log_{10}$ $FAID_{50}$.

The vaccine was titrated prior to the day of vaccination. Lyophilized culture of avirulent *M. hyopneumoniae* was rehydrated on the day of vaccination. A sample of vaccine was retained and a viability assay performed before and after vaccination to determine CFU/ml. The vaccine remained on ice during the course of vaccination.

All pigs were observed daily for temperatures and clinical signs starting two days prior to each vaccination continuing for 7 days after each vaccination. Pigs were observed for clinical symptoms, which included, but were not limited to, coughing, sneezing, nasal discharge, depression, inappetance, and labored breathing.

The pigs were observed for 7 days following vaccination for any adverse reactions to the vaccine. Three pigs died during the post vaccination observation period due to non-MH or PCV related causes. A summary of the clinical observations from the post vaccination period is found in Table 7.

TABLE 7

| Group | # of pigs | Treatment | Dosage | Observation after vaccination |
|---|---|---|---|---|
| 1 | 24 | Vaccination | 1 dose | No adverse reactions noted due to vaccination |
| 2 | 24 | Vaccination | 2 doses | One pig died in this group due to intestinal perforation. On 5 days post first vaccination one pig had a temp of 105.5° F. and labor breathing noted for one day. |
| 3 | 24 | Saline vaccination | NA | On 6 days post first vaccination one pig was noted with labor breathing for a single day. |
| 4 | 4 | No Vaccination | NA | Housed with group 3 pigs during vaccination. No adverse reactions noted. |

NA: Not applicable

All pigs in Groups 1-3 were challenged with a virulent strain of *M. hyopneumoniae* at approximately 7 weeks of age. Pigs from Group 1 were challenged four weeks after first vaccination. Pigs in Groups 2 and 3 were challenged two weeks after second vaccination. The virulent *M. hyopneumoniae* challenge stock, a frozen (−70° C.) lung homogenate (LI-34) was thawed rapidly under warm water and diluted (1:100 dilution) using sterile *M. hyopneumoniae* growth medium. Pigs were sedated with a mixture of Xylazine-Ketamine-Telazol™ comprising 50 mg/ml Xylazine, 50 mg/ml Ketamine, and 100 mg/ml Telazol. Each pig was given 10 ml of the challenge material trans-tracheally.

Pigs were bled for serum on day 0, 14, 28, and 56 of the study. Serum samples collected from this study may be tested to evaluate animal serological response to *M. hyopneumoniae* and PCV2 using ELISA methods well known in the art. Serum samples collected from zero-days post vaccination (0DPV) and zero-days post challenge (0DPC) may be tested for antibodies to *M. hyopneumoniae*, Swine influenza (H1N1), and porcine reproductive and respiratory syndrome (PRRS) using commercially available ELISA test kits.

Four weeks (28 DPC) after challenge, all pigs from groups 1-4 were euthanized and lungs were removed. Lung lesion scores were recorded and typical *M. hyopneumoniae* lesions were formalin fixed. Samples were examined for histopathology. Swab samples from one *M. hyopneumoniae* affected lobe were collected for bacterial isolation for detection of secondary infections. In addition, bronchial alveolar lavage fluid was collected. The lungs were lavaged with phosphate buffered saline and the resulting fluid was aliquoted for testing by PCR.

For the evaluation of reduction in the severity of lung lesions, the estimator was the mitigated fraction (MF) statistic. The mitigated fraction was calculated as:

$$MF = \frac{2W_1 - n_c(1 + n_c + n_v)}{n_c n_v}$$

where:
w₁=Wilcoxon Rank sum statistic
$n_c$=number of subjects in the control group
$n_v$=number of subjects in the vaccinated group
The 95% confidence interval for the mitigated fraction was calculated.

For the claim of reduction in severity of lung lesions:
$H_O$: $M_v = M_c$
$H_A$: $M_v, M_c$ where:
$M_v$=Median of the lung lesion score in the vaccinated group
$M_c$=Median of the lung lesion score in the control group The frequency distribution of the continuous outcome variables was assessed using PROC UNIVARIATE, which performs parametric and nonparametric analysis of a sample from a single population. (SAS Institute Inc., Cary N.C.). Log transformations of the antibody titers were employed to meet the normality assumption required for parametric tests. Baseline evaluations to evaluate comparability of groups for litter and room will be made by chi-square. The severity of lung lesions was compared between each vaccinated group and the control group by Wilcoxon rank sum test (PROC NPAR1WAY with lung lesion score as the dependent variable and treatment included as an independent variable. PROC NPAR1WAY, which performs nonparametric tests for location and scale differences across a one-way classification; PROC NPAR1WAY also provides a standard analysis of variance on the raw data and statistics based on the empirical distribution function. (SAS Institute Inc., Cary N.C.).

All statistical analysis will be performed using the SAS system. In cases where transformation did not improve the distribution of the residuals for any transformed variables as determined by the W test for normality, non-parametric tests were employed as needed. The level of significance will be set at $p<0.05$.

On the day of necropsy all pigs were euthanized, lung lesions scored and swabbed for bacterial isolation. Bronchoalveolar lavages (BAL) were also collected. Bacteria isolated from the swabs consisted of the following: *Actinobacillus* species, *Moraxella osloensis*, *Streptococcus sanguinis*, *A. pyogenes* and *Bordetella bronchiseptica*. BAL samples were tested for MH by PCR methodology; two samples from environmental control group with lesions recorded and two samples with low lesion scores in the vaccinate and control group. BAL samples for both pigs from the environmental control group with lesions were negative and both pigs in with low lesion scores in the vaccinate group were positive. The statistical analysis for the lung lesion scores is in Table 8.

The statistical analysis of the data met the criteria for the mitigated fraction (<50%, with LCL >30%) for reduction in lung lesions. The vaccine is considered efficacious for the MH fraction with a 2 mL dose administered IM, either single dose or double dose, at $2.09 \times 10^8$ CFU/mL. In addition the vaccine is considered safe due to lack of clinical signs related to MH or PCV following vaccination.

TABLE 9

SEROLOGY RESULTS FOR EXAMPLE 2

| Pig ID | Group | ODPV1 | 0DPV2 | 0DPC | Necropsy | Lung score |
|---|---|---|---|---|---|---|
| 730 | 1 | <50 | 100 | 400 | 400 | 9.5 |
| 733 | 1 | <50 | <50 | 100 | >400 | 35.5 |
| 735 | 1 | <50 | <50 | 100 | 200 | 5.5 |
| 740 | 1 | <50 | <50 | 200 | 400 | 5.5 |
| 742 | 1 | <50 | <50 | 200 | 200 | 0.5 |
| 745 | 1 | <50 | <50 | 200 | 100 | 0.9 |
| 754 | 1 | <50 | <50 | 400 | 400 | 6.8 |
| 755 | 1 | <50 | <50 | 400 | >400 | 0.0 |
| 761 | 1 | <50 | <50 | 200 | 200 | 4.5 |
| 762 | 1 | <50 | <50 | >400 | 200 | 0.5 |
| 763 | 1 | <50 | <50 | 400 | 200 | 2.7 |
| 771 | 1 | <50 | <50 | >400 | >400 | 5.5 |
| 774 | 1 | <50 | <50 | >400 | >400 | 0.0 |
| 732 | 2 | <50 | <50 | <50 | <50 | 1.8 |
| 738 | 2 | <50 | <50 | <50 | <50 | 5.9 |
| 739 | 2 | <50 | <50 | <50 | 50 | 18.2 |
| 743 | 2 | <50 | <50 | <50 | 50 | 19.1 |
| 747 | 2 | <50 | <50 | <50 | 200 | 0.5 |
| 749 | 2 | <50 | <50 | <50 | 50 | 21.4 |
| 752 | 2 | <50 | <50 | <50 | <50 | 9.5 |
| 759 | 2 | <50 | <50 | <50 | <50 | 15.9 |
| 764 | 2 | <50 | <50 | <50 | <50 | 26.4 |
| 768 | 2 | <50 | <50 | <50 | <50 | 31.8 |
| 769 | 2 | <50 | <50 | <50 | <50 | 16.8 |
| 773 | 2 | <50 | <50 | <50 | <50 | 10.0 |
| 726 | 3 | <50 | <50 | <50 | <50 | 0.0 |
| 744 | 3 | <50 | <50 | <50 | <50 | 0.0 |
| 750 | 3 | <50 | <50 | <50 | <50 | 0.0 |
| 767 | 3 | <50 | <50 | <50 | <50 | 1.4 |
| 770 | 3 | <50 | <50 | <50 | <50 | 0.5 |

Group 1: SP Oil vaccine (vaccinated and challenged)
Group 2: Control/challenge (unvaccinated and challenged)
Group 3: Non-challenged control (unvaccinated and not challenged)
ODPV1 and ODPV2: The numbers indicate the highest dilution that was positive in the ELISA test after the first dose of vaccine (ODPV1) or after the second dose of vaccine (ODPV2).
ODPC: The numbers indicate the ELISA results Post Challenge. The higher number indicates seroconversion.
Lung Score: The number indicates the percent of lesions in the lungs of the animals. The higher number indicates a greater number of lung lesions due to a lack of protective immunity. The lower number indicates a healthier pig with fewer lesions due to induction of a protective immune response.

TABLE 8

| Group | Protection ratio | MF litter adjusted | MF Lower confidence level | Litter adjusted percent lung lesion score | LCL lung lesion score | Standard deviation of lung lesion | Mean percentile for lesions |
|---|---|---|---|---|---|---|---|
| Vaccinate IM single dose | 1/23 | 58.4% | 31% | 8.84% | 6.68% | 4.99 | 0.38 |
| Vaccinate IM double dose | 4/19 | 71.2% | 48.7% | 6.62% | 4.37% | 4.67 | 0.3 |
| Control | 0/23 | NA | NA | 19.27% | 14.62% | 10.76 | 0.69 |

LCL = Lower Confidence Level
MF = Mitigated Fraction

SEQUENCE LISTING (1 sequence)

SEQ ID NO: 1 - DNA, 897405 bp, Mycoplasma Hyopneumoniae
tttttctcctttttttgcttaaatttaagttttagaagttattttaagggattttaaaaaaatattgttaaaatttaaaaccaaaatcaactttattaaatgtgctaaataaagttgataaaatgtttgcaaaaacatttttgttgttttaaacaaaacaaattgatttaaaaattatactacaaaattaaaggaaaatttataaaatgcaaacaaataaaaataatttaaaggttagaacacagcaaattagacaacaaattgaaaatttattaaatgatcgaatgttgtataacaacttttttagcacaatttatgtactcaacgagacagaaactgaaattattatagattttacagacttaatcgcgaaacaggaagtgatttcacgctgagttgatacggttgaaaaagctattaaaaatcttgaaatttcaaaaatcctaacttttaacaatacaaataattataccattaattcaaaagaaagccaaaacttttccataaaaaataaatattgcagctttaatattaacaatgttttaaacaaatttacctttagaaactttataaaatcaagttataatttccaaatttttagtatttatgacgcaatagtcgcaaattcaagactaaattactcaccaatttttatttcaggaccatcaggaattggaaaaacgcattttattaatgcgatcggaaatttacttgtagaaaaacagaagaaagttttctacattaacgactataaatttatcagttgcgtttcttcctggatgcaaaatggtcaaaatgaaaaaattagtgaatttttaaactgattgtctcaagttgacgcttttctttttgatgatatccaaggtttggctaacaaacaacaaacttcaattgttgcacttgaaattttaaatagatttatcgaagaggataaaacagtgataataacatctgataaatcgccttctttacttggtggatttgaagaaagatttataacgcgatttagttcagggttgcacattaaattaaacaagccgaaaaaagaagactttttgcggatttttaaacataaattagttgaagaaaaattagaaaaacatatttgaacaaatgatgcttttgaatttttgtcaaagcattttcgaaattcgattcgtgagcttgaaggtgcgctaaaatcaattgttttttatatccaaacaaataaaaataaatttgagaatgaaatttattttgataagaaaaaaatgtttgaaatttttgttgaaaaatatgaaatcgaacaaacaattacccctgatttaatcattgaggttgtctcaaaatattatggcgtctcaattttagatataaaaagtgaaaaaagaggcaaaaatattgtgcatgcccgcgatattgcaatctgattaattaaaaatattctggatttaactcataatagcgtaggaactttttttaacaacagaagacattcgacaataatttctacccttaaaaaaattgataccttaaaacaaagcaacaataatgaacttgaaattgcacttaaccacatttataaacaattaaactgaagttttaaacagcgaaaataaaaatattaaacagcattttggacaaaaagtactataaattaaagtggttttctattttttctacatttctacagccttattatttttattattaaaactaaataaaaattaaccaaatataatataattattagaggtaaaaatatgaaatttacaattgaaaaaaaaattattgaatgacaaattgaaagaatgcaatcagcaattctaaataatataaattcaccattaagttcgttttttttaaaacttacaagaagcggattatttataatttcaacaaacagtgagctttcttataaagtttttattaataaaaaagatttaattgaaattcatgatgttggaagttgcttaattgacggtgtttttttacgtgatgttattagaaaaagtgataaacaattaagttttcatctaattggttctgaattaaaagttttttgggaagatgctcttttttcaaagacaactcgggattcttctttttttccagaaattaactttgagcaaaaaggaattaaattaactgtaaatgctaaaaattttaaaagagcgataaaaaatacagcttttgcaacaacaaataatccttcacagccgattttatcggcaataaatcttagatctgaagccggttttctacatttttcggcaacagatacatctcgatttgcctcagaaaaaatcgaaatttcgaataaaagtagaataaatatttctgttagcgcgaaaaatttaaaagattttatcccacctgaacttgataaggatatcgaattaaatattgaatcttcaaaaattagttatatttacgataatttaacaatccagtcgcgaattttcactattgaatacaaggatatttcaaatatcctaccaaaagacagcgaaattttatactcacttacaatcaacaaacgcgacatcctcgatctgattgataaaacaacaataattacccccggaaaagataatgttattaacctttcgttgtcaaaaaatgcgttaaaaggctatatttctcaatatgattcgggtcagtcgaatgttcagacaaaaaatgttcttgatttcagatttaacccaagatttgcatcagattttcgattcgaccctgaattagctcaggttaatataaattatcgctatttaaaagatgcaatttctgtttttgataaagtaattgatattcacattaatgaaaaaatgaacaaaatgttgatagtttcaccagaaaaaccagaaatttgtcagttagtcggtcttgttttagtctaaattttctctaaaatttagactattttttttgattaatatttaaaaaaaataagctattttatagtataatttaaaaaaagaaactaatttgaggaaatttttaatgtcaaaaaaatctaaaaattcaagcattgaatttgatgctattgttgtcggtggcggccatgctgggatcgaagcagtttatgcattattaaaaaaaaagttaaaagttgttctaataactcttgataagaaaaaattagcttcaatgccttgtaatcccgcaattggtgggccagcaaaaggaattataactcgcgagatcgatgcccttggaggagttcagggaaaattttcagatttagcaatgatccaaattaaatatttaaatgaatcaaaaggtcctgccgttttagcaattagagcccaaattgataaggaaaaatattcaaaattaatattaaaggatttgaaaaaacaggaaaatttattaattatcgaggatttggttagtgaacttctagttgaaaaaaatcgtgtttttgggctaaaaacagcgaaaaaacaagtgtttttttcaaaaaccgtgattattacaacaggtacctacatggattcaaaagttcttcgaggctcattagcgattccaagtgggcctgatggtcaacaaacttcaaatttgctttcaaataatttaaaaaggcttggttttgaacttcaaaggttaaaaactggaactcccccgcgaatttttacttcttcaattgacttttcaaaagttgaaaaagaggttttgcctgtttataatataaatttttctttccaatcaaagcataagataaaaaaacaaatttcttgttatttgacttatacaacagcaaaaactcatgatataattaacaaaaatttaggaaaatcctcgatgtattcaggtctaatttccggtgttggaccacgttattgtccttcgattgaagataaaattgttcgcttttcagaaaaacctcgccaccaaatatttttcgaaccagaaacaaaaaaacaagatataatgtatattaatggcctttcaacgtcgatgcccgaggatgttcagcttgaaatggttaaaacaattcctggtctggaaaatgcaaaaattgcaaaattcggttatgcgattgaatatgatgccctaaatccgcttgaattgaaaaaaagtttggaaactaaaaaagttaaaggactttttatggcaggtcaaatcaatggaacaagcggatatgaagaagccgcggctcaaggtttagtcgccggaattaatgcgggccaatttgtgcttgggaaaaaaccagtcgaaattttaagaaatgatggttatatcggcgttttaattgatgatttagtcactaaaggaacaaaagaaccttatcgtatgctgacttcacgtgcagaatatcggcttattttaagaaatgataatgccgatattcgaatggcaaaatatgctttaaaatcagggctgatctccaaaaaagagtatttgaaaatcaaagcaaagtatgcaaaaattgacaggaaaattttagaactttctaaagaatttgtttccccaaaagatgaattagcaaaaaaatataatttggagaagcgaatttccaagttaaaattaatttcctgaccaaatgttaactttaaagatattctccctgattttgaattcggatatgaattaactgtgatggcccggctaaaaggttatattcaaaaacaaaattctgaagcccaaaagatgattcgactggaaaaattactgattccaggcgatctaaattatgaaaaagtcgcaaatttgtcatcagaagctcttgataagtttcaaaaagttagaccaaaaacaattggggaagcaagtagaattagtggtgtaaatcctgctgatatccagatgcttttgtttcatattaaagttttaaaaatgcaaaaagtctctaaaatttaatgaaaatttcaataataagttttggttctagccccagagaatgattaggtttatacaaaaaagaaattaataaaatcaaacagtttaaatatcaaatcgaatttatcaacctttctgagcattcccaagaaaatatagagcttaaaaaaatgcttgaaacaaaggatattttgcaaaaaattcctaaaaattcatcttgttatctttttacagaaaggggaaaaacagtaacgagtaaagaattttcccaacttttgaatttctcgaatatttgttttataattgggggttcgtacggcgttgatgaaaaattaattgcaaaatcaaggccagatattggttttttatcatttggaaagctaacttttgcccataaaatttttaagcttatcgttttagagcaaatttaccgtggtttttcgattaaatttaatcgaaaataccaccacgccgattaaaaaaagaggtaaaatgaaaagaaaaaattatgaaaaaataattcaaaacattgaaaatcatgataatatttttatctttcatcacatcagaccagatggagattgtctgggtgcccaacaaggttttggttatgcgatcgcaaaaagattccctaaaaagaaggttttttttattggggataatgaaaatatttttaattttttaaattttcattttgataatgaaaatttaattcaagatgaattttttcaaaattcacttgcaattacagtcgatactgctgatattaaaagaatcaaaaaattagatttttttctaaattcaaattttaaaacacgaatcaaaattgaccatcaccctgatatttttgaggaaatttataacgaaaaatgggttgatccaactttttcggctgcttcagagatgatagggtacctactaatggaagaaaattgggaaattaatagtgaaatttccaaatttatatatttaggaattctaactgattcaggccgttttttatttccttcaacaacctcaagaacatttcaggttgctgcttttttgatgaaatttaattttgattttgcaaaattaaattgatttttgtcgaatagaacagaacaagaagtcgctttttgtgctgaagttttagcaaattataaaaaaaaagataaggttttatggtattttgtctcaaaagagatacaaaataaattcaaattaagaaacgatcagttatcagccgttaatattttggcaaacattggcgatgcccgaatttgactatttttgattgaaatggagaatggaatccgtgttagaatacgttcaaatggtccaaaagttaatgaaattgcttctgaatacggaggtgggggccatgagtatgcagcaggtattaatctagaaaagtcagaaaaaactaaggaaatttcgcaggaaattatcgagaaattagttattcaagtaaaggaatttgaacaaaatgagtaatattaagataaaagaaattataaaacttatcgaaaatcacgatacaattgtaatttttcaccatatcagaccagacggggattgtattggcgcacaattagggcttaaaaatttaattttagataattttaaaaataaaaaagtttttgcagttggcaatcacaaaggatcattttcatttttgaatgcaaaaacagattcaattcccgataagctaattttaaaaaattctttggcgataattgttgatgcaaattttaaaaatcgaattgaatctgtttttttatttgatcaatttaaatttaaaacaattctacgaattgaccaccatccaaatgaagatgattttgaacaaatttaccgttgagttgatccaagttatgttgctacctgtgaacaaattgccgacttggcatataaagcaaaatggaaaatttcccggaaaagtgctacattcatttaccttggaatttatactgattcaggtcgttttctttataaaaatacatcagctagaacacattttttgacaggaatattatttagaacaggatttaattttgcattaatccacgaaaaactaaatcaaaaaaaattatctgatattgattttgatagttatattttttctgtgaaaaaaatatataaaaatgtaattttttacacattgagtatggaagagcagaaaaaattaaataaaaatccctcaaattcagtgcgcccaaatttactagcgaatattgaaaacttcagaatttggttgtgtcttgttcaagaaaaagaaaattcctggcgggtagagtttcgttcatccggcccaaatgttcaaaaagttgctcaaaattgaggaggtgggggtcatcttaatgcttcgggcgcgattattgaaagtcttgataaattagatttattaattaaagactgccaagctgaatatgaaagttgattttctcagttaaaataaataataaaaaaggaaaagtaggcgaaaattactaattttttccttttttttaataaaaggctaaaaaaaattaatattggtggatgttgaaaggagaaactgatggaaggaatcaatataactaattttttaaaatatctatttgcatattattatattgatacaggtgaaagggaggtttatcgaacatgagtgcaaaaaatactttgatttacacattgaaaattttatagaatgtatcaaataccgtttttttcagagaattttcaatcttataaatatgggccaatttcctgaactgtattgcagacgcaattttttggtatcgaatccttcaaaaattcacaatacaatattgacgaaatattggattttcaccaaaataatcttgttgacgagtttaaaaatcgactaaaagaagactttttaaacgactttaacgaagattttggcgaaacatttgatgaaaatcaaataaaaggcgatttagatctaagatgatcttgttttgtttttgtttttgaaaaattaaaaaaatttcgcccaaaggatttaataaatttatctcacagccaaaaatcatttaaaatagcggctaaaaatccccactcaaaggttatttttaatgaaacaattcttgatgatgaggaaatttctatattagaatcatagaattttaaaattatttattaagaactgaacggaaaaaagtaattttaatttataatttaataaaattataaaaattataggaattaaaaatgtctttttttcgaaaaattagagaaaaaatttttggtacaaaacaagaaaaaccggcaaatttggataaatatgttgccggtttaacaaaatcaagactttcttttttcaaacaaatagttcagcttcaaaaaaaacatattaaaattgatgaaaatttcttcgaagaattagaagaaattttaataatgtctgatatttctccaaattttgtcagaacaataatagactcgttaaaagctgaagttcgccatcacaatctcaataatcccgatctaattcccgaaataattatggataaaatgtatacaatttattcaaatcgttcagttgtcaacacaaatttgaacataaaagacgggagaatcaatgtttttttaatctcaggggttaatggttctggaaaaactacttcaattgccaaagtcgcgcgaaaattcattatagaaggaaaaaaagttcttataatcgctgctgatacttttcgggcagccgcagttgagcaacttgaaatttgagctaaccgcgtaggggctttaattttaaaacccgaagctaatgaaaaagatcctggatctgtagttttccgcggtttggattttgctattaaagaaaaaaccgatttggttttaatcgacacagccggacgtttgcaaaacaatgtgaatttaatgcaggaattaaaaaaaataaataaaataatttcccaaaaggttcctaatgcccctcatgaatcacttttggtaatcgatgcaacaactggtcaaaatggggtttcgcaggcagcaaattttgcaaaaataactcccgtttctggtataattttaacaaaaatggatggtacaagcaaaggagggatcattttttcgattaaagatcaacttgatatcagtgttaaattagttggacttggcgaagcgatggatgatttacaacctttcgatcttgatttgtttatttttgcaatcacaaaagaagttaaaaatcaatatcaggtttaaatttttacttattttttacctaatttttaacaaataagtaaaaatttaagtattttttctaattttttcaataaaataaaaaaaattagaaaaaaaataaatttggttaaataaattttccatttttgtaaaatttatttaacaaaaatggaaaattaaaggaaattaatggctaaaatcagtttttttgcacttggtgggcaagacgaaaatgggaaaaattgttatattttagagattgacgataatattttcataattaattcaggggcaaaaataccactggatagttcagttggtgtcgatacaattattgcagattttacctatcttgaggaaaatcaacataaaatcaggggtgttttcatcactgatgctaaaaatgaatcattttctgccttgccgtggttgataatgaaattgaaaaaaatcaagatttatagctcttttttcacaaaagcactaattattgaacgaatccataaatacagactgtctgaatctgcttttgaagtaattcctataacttctgagctaaaaatcaatgaaaagatatcagtttctccttttccagttgcgggttctatgcccggaacaattggtttttgctttcacacagaggatggcggaatcgtttttatggctaattatgtcgttgggaatttaggtgtttatggggagacaaattttgaattgatcaaaaaaattagtcaaaatccaaaaggcattttgatgtttatttctgattcaggtaagtcaaacttacctggaaaagcaataaataaactttttgcaaaaaattttttagaaaattttttcttaaaagccgataaaaactcgcgaattgtggtctcagcttacgatgaagaaatggtttcaatacaagaaattattgatctttcgataaaatttaaccgccaaattaccgcttatggtaaaaaatatgataaattatacgatatgatctacaagttagataagctaacaactaataaattaaagaaattaccgacattttttgactataaatatgcaaataaacagaaaaattcggtgattttgattacttcaagtcccgaaagaatttgttatcgctttaatagaattcttgaaaacgatgatgtttattttaaattaaaaaaatctgattatgtgataatgttgacccctccaatcaacggaatggagcaactttatgcaaaagttttagaccagattgccaaatcaacaacaagtattgttgatatttcagaatcagattttggacttgctcgcccttataaagaagacatttctgagatgattcagcttctaaaaccaaaatattttcttccaattcaaggtttatatcgctacttaattgtggcctcaaatatcgcggttgcaaataaagtcaaacgacaaaacattatcgttttgcaaaataaaaggtctgctaatttcattgatggtagtttattttcaagaaaaaaaatttcaaaaggtgaggaagaaatttatgtttctggttttgggattggtgatgtttgctttagagtactaaaagaaagagatgctctgtcacgcaatggtttgattattgtttcttttttattcgatccaatcgaaaaaaaaattttttcaactccagagattacgacatatggaattttaagtagggaaaatcgggaagcttactatgatattattagaaaaattatttttaataatttttctaatataaaaaaaataaatgataaaatactaaaggaattgcaacaaaaaagtcaaaaaaatataaagcgaaaacttttaagaatttttgacaaggaaccaagcgtttcagttctaattcataatatttatccagaggtaaaaaaaatgaaaaaaatgctatgaaaacaagccgaaaacgaattaaaaacaggcgtagtttaccttgaatttgcagcggattggtgtaatgactgtaaaatgcaagagcctgtaaatgaagaattaagcaaatattttaaagaccgaagtgatgtaaaattaattaaagttgatgcggaagaatccaaacttttccgtcaaaaagggacaaaatatgaagtactttttgtcccaactcattttatttttaaagatggacaaattctttttaagcagtttaattatgttccagccgaagttttaattgaaaagattgaaaaagcacttaattcatagtaaaaattttttaaaaaaataaagcaaattactagataacaaattttgctaatttgctttgttttttgttataatttaccaaagatgccaaaattagactcaaaaaaagaaaaatatcttaaacaaatagtcgaaaatttcataaaaaccggtgaatctatcggttctcttaacttaaaacaaagttatggtatcaaaaaatcaccttcatatcttcgggcaattatgaatcaacttgaaaaggaaggattcttagaaaaatctcatagttcaagtggcagaatcccgactttacaaggttttcaatattatgcggaatttttatcttttgacgaaaatgaaaatttagcaaacaaattaaaagatttattcgcccgtcgtcgcataaatattgaaaacacaatttctgaagccgttaaattaatttctgaatcggttggtactaccctaattgcaacaacaaataacgaaaatgaacgattaatgtcaataaatttaacgcaaatttcccaaaatgaaggaattattgttgttgttagttccagtggtaatgtggaaaataaaaaaataactttttctgaacagattccaagacaagatgttaaaattgctattagacttttccaggaaagattaataaatacacctttgcttgaaatttcttcaaaattagctattttaaaacaggaattagagaaacaaattaaacacagcgatgaacttttgcatcattttatggaaaaaatttttaattttcaagtccaaaataagtctaatatctacaataaaaattcgctgattttggacaaggagatttcgcgggccaaacttgttgatttactttatataattgaaaaaaaatcaatttgagaaatgcttgaagatcgaacaacaaaagacgatgataccctaaaaatcagtataaagtccccagaagtttcatttatttcgaaaaaatttgaaaaatttttaccaattaaggaaatcagtatggttggagcagctaaaaaaattaattattcggccgctcgaacaggtataaaacttttggaagattttttatcaaacaaaagcaagattagaaagggataaaaatggtatttggtgataaaaaattacaagaatttgaaaataatttgcaaaatttgtcttctgataatgatttagaagacaaaaaagttataaatcctgatgaaaaacaagggctcgaaatagataaagaagtagaaaaaactgagaaaactgagaaaaaaactcgtagatttttgaaaaaagaagcaaaattaaaagaccttgaaaatcaaattcaaaatttaaccactagaaatataactctcgaaatcgaagcaattaagttaaaagataagatcaaaaagttagaggaagattttaaatctcaggttaaaacttttgaagaaaaagcaacacaaaaagtcaaagaattaaaacttgatttacaaaaaaagctcgaaaatgagcaggatttacttaaaaaatacagtttacaaccattttttgaggattttagctcgccttttttaaacctaaaaaaagctatttcttatggtttaatctctcaaaatcccgaaatttccgcgtatgtaaaaggttttgaaatgcttgtaaatcaaattgaaaatgtaatggaaaatttcggtttagtcaaaatatatcctaaaataggtgatttttttgactcatcagtccacgaaatttatgaaataaaaacaggggaaaatgataaaatcattgaagttgtttcagaaggttataaattacacgaccgaattgtgaaaacagcgcttgttgtagttggaaaacctaatgaagaaaaaaattagccaggcaataattaaattttttaaaaatgaaaatttaattattgatgaaagtaaactaattattgaaaagtcaaaaaattttggtgattatagctctaatgttgcgctaatttttgctaaacagaacaaaattgactccctaaaattagcacaaacgattaaaaatcaactactttcagaaaatttaaatttagaaaaaatagaaatcgctccccccggctttattaatttttttatttccaaaaatgaatatgcaaatatagtttcagaaattattcaaaaaggtgaaaattttggccgttattccttacaaaaaaaaataaaccttgaatttgtttcggcaaacccgacaggttttttacatcttggtcatcttcgaggcgcagttattggtgatattttagcgaatatccttgaatttagcggaaattttgtttttcgagagtattatattaatgactttggtagtcaaattgatcgcttggtgggctcagttttttcccgatatcaacagatttttaaaaaattcgctcttcctgaagaagcttatcttggcgaggatataatttggtgcgcgcagaaattttttcaaatttatgcaaataaatttgaaaattcatcacttgacgatttagaaacttataaaattttccgtgaaaaatctattgagatttttcttgacgaaattaaagctgatttggcaaatttatctataaaattcgatgtttttagctcagaaagcgaactttttaggactgagaaagttcaaaaaaatttagcaaatttaccttttgtttataaaaaagaagaggcaatttggcttaaaacttccaaatttggtgatcaaaaagaccgtgttttagttaaaaaaaacggagaatttacttatttttcaagtgatattgcataccattttgaaaaaattaatagtaattttaagccggattttttgataaatatttggggggcagaccacattggttatgttgatagaatgaaagcggccctaaaaactgttaatttaaatcaaaaattagatattttactatatcaattagtaaaattattcaaaaatggccaagaatttaagatgtccaaacgaatggggaaaacttttacgattaaggatttacttgaacttgttgatcaagatgcaatccgttattttattagtgaaagaagttataactcacttgtcgaatttgatatcggtctagcggctaaaataagcctgcaaaatccgttgtttttaattcaatatgcccatgcaagggcctcgaaattgttggcaaattcgacaatagttccagaaaaaatattaaaatttgaagctgaaaacgagactattttgatttcaaaattaaaacaatttgaagaaattgttttaaaaattacaaaaaattataaaattaacctcttaaacaaatatttgcttgaattagctaatctttttaactcattttattctaattcaaaaataattggtaatcaaaatcaaaatagtctcttatccctgacaaaagcagttcaaatagtactaaaaaatggactaaaattacttgggattaaagccaaagaaaggatataaaaacgtgaaaacaatcatttcgattgcaattgattttctaaaaaatcgtgaatccgctcattttagcgacatttttttagaagttcaaacttctttgatgtcaaaatgagaaaatcaactacctaatttatcaacagataaaattttaacactaaaacggggcgaattatacaaattactatcaattgatggtaattttgtcccactcggcgataattattgaacacttagatcagatcttaacgcttagtttttttttttttttttttaaaaggtttcgactgcaaaaaaaaaaaaaaaaaaaaagtatcgaaagggaaaaatgcaactagtaaatactaaagaaatgttggaaaaagcactgaaaaataactacgcaattccacatattaacattaacaatctcgaatgaacaaaagcggcacttttagcggcccaagcaaaaaaatcacctttaattattggcacttccgagagagtactgacatatatgggcggactcaaaactatttataatttagtaacaaatttaattgactattttaaaataacagtcccagtcgctctccatttggatcatggaacttatctcacctgcaaagaagcactaaaaaacggctatacctcagtgatgtatgatggttctaaagaaaaatttgaactaaatttggaaaggacagaggaaattgttaggctagcaaacaaagtaaatgcaaccgttgaagctgaagttggccaaattgggggtgaggaagatggtgtaattggtaatggagaaattgctgatccggaaaatgcaaaaaaaataacagaaactggaattacatgtctggcagctggcattggtaatattcacggtatttatcccccagattgaaagtccctgaattttgagattttagaaaaaatctcaaaagtaacaaagattccgctggttttacacggagggagcggaataccaaaagaccaaatccagaaggcaataaaacttgggattgcaaaaattaatgtaaatacggaattacaacaggcaaatgcggccgcaatttccgaatttgttctttcaggaaaagtaaaacaaggtaaaaattttgatcctcgaaaattattagcacccggaactgatgccattcagcttcttattgaagaaaaaatcacagaatttggttctgcaaatcaagcataagttttaatgattaagtttgtcgcaacaaaaaatcaaagcggccaaaaattaattcagttaattaagaaaatacttttgaagtcgaattataacgaaattcaaaagtattttcgtactaaaaaaataaaagttaataatactttccaggaaaagaattatatcataaaagaaaaggatataattttaattttttctcaagaaaaactaaaaactttttcaaaaaaagtgcctgaatttaagttaaatttgaaaattatttatcaagatgaaaatattttactagttgacaaacctcaaaacttacaagttcatggtggtagatttaacctggatttagcagtctgaaattatctaaaaattccagaaaatcaagtttttaaaccttctcatattggcagacttgataagaaaacttccgggattattttatacgggctgaactatcaaagtgtggtcgaacttaatcagaagcaaaaattttttgaaaaaatttatacttttaaatcagatataaatttaaaaaacactataaaaacagatgtttttattagaaaaaacaactttcaacaaaaaatggaagttactttaaaatcaccaaactcattttttgcatctacaactttttattctaaaaatcaaaaaaaatttgccattttacatactgggaaaaaacatcaaattcgagttagcttatcacatttaggatttccaatttttggtgatgaaaaatatggtgggactagggataaaatactttatttacatagtttttcactaaaattttctggattaggaggctttttatcatacttaaataacaggaaatttatttcaaaaccaagttgatggtaggggcaattttcaccattttattattcttattatctaaataaaggctaaaattaacactagcttatacaaggtgttaagtaaaaattcattatttttatttgaataaacgctaatttctttattgcctaattggttattaattttatattttagtgatattaatttgaaaaagttaataaatttgaaattcttattgatttcaactgtttcagtatttcaatttgtggaaatttttgaaataaatactatgttctgtttgttgatattcttaaaattttcgaaaaaataattgatatctgccaagtaaatttcattacttgatattattttttcgtttttatttaaggaatttattttttcaaaaaaaaaaaaaaaaaagtataaagaaataaacatagaaaaaggtaagcataaaaattttaattaattttttttgaaaaagtattttatatataaccttattttttattaaggaaccaaaaacttaaatttccaatatgtttgaatttaagttttttacaagtcactagtaaacctatataaaatattattagggctaaaattggaatatagttgatcaaataattgaaaaactagtgtgattttctatgtgtatgttaattttgcagaatcctgatgtgaaaaccttttgtaaatttcaggaaaataattggaactataaaaatgaaatctgaatttcccgaaaaagcctgtaaaatagcgattttttgcttctaaccgccagatagatctttgacttgttgatttagtttttcaccttgagtattaagaaaatttgctcttttttcaagcaaattctgattaaattctttttgaattaagctatttccaattaaaatattatttttaacagaaagattttcaattaggttaaaatcttgaaagactgcattaattaaagggtttttctcttcattcgcttttatatttcgttgcaaaaacaacaatcaaattaattaaaactgatttttaccaaccaacttttcaactagaaatgtcatcttatttgaaataatttctaggttaattttcttaagaataattttataactgtttttttggttaaattattaatttatattttagatatttttatagtccttattttagaagttgaaccaccggtttgctgtaaaaaaatcatgaaattaacaaataaataaaagaaagaataaaaaacaatataattcaaactaataaaaaataaagacaaacttgctcatatgaaggaaatctgtagttattgtttgatatcgctgaataaatttcaggagtaattgggactattaaaattagcccaaaaacaaaaattaaaaaggctataaaaattaacgtcattcaatggtatccgaaaatccgggctgtttttgctcccaaagctttcaaaaccccaatcattttccgcttagaatctgttaaattttttgcataaaaaattgttaaaaccacaaggctaagtgaaaaaataatcaaaactgtaaaaattattacttgagtgagggtttgtaggtcgaaaaataaattgttgataatagaacttttttcaataggttcaaattctgggaaggttgatttaaatttttcaatattttcacttaaatttttatgctcaaaaaatacttttaaaagtaaaggactcaaattttttgattctggaataatagaatgatgaaaaataacttcatttttaatcgttgtttttagatctgttttagctttgatattttgtttttcttggtcattttggtcgaaaattccgactattttgaaattaaatatctgtccattatttttacttaaagaagaaattttactatcaattaaagattttttttcattaaaacttatgtagtcatttaaattctttgaaattgcaatttcattagaattttttgggaaatttccttctaaaagtttaaattttttaatttcaggctgattttcatagtaatttttggtaatttctaccctttttaaatcgtctgattctacaaaagagaaaatttgatcatttttatcaacattttttgtattttcaaaaagcgttgattttggcaaattaaagtgaacaaaagataaattaagattatcattgttaaaagaattatttactccaacaattaaaagctcctttttgtttttattatttaaaaaatcgataaatttaattttttttccaattggatctttaatttctaattcactagcaagagctgccgaaattataatttcattctcatttttaataaatcggccttgtaaatcgtttgttccgattttgaatcttttgctaaaaaattcggattcatcaacaaaatcaacaggagaattttttggctggttattattatatgaaaaaagcatagttggggcgctatacaacggtagaatttttactattttattgctacttttttcaattttatttatttcatcgttttcaaatttatcataattactgttttttctgattaaaactgaatctaaatgttcttgaaaaattttctcagtattgataccctgaacatttgagttgagcacaccgaataaaacaattccaaaaattgtggctaaaaatgaaaaaattaataaaattgttgttattatttttgatttaaaatcaacaattgacaacaaaagcccagttttgaatttgcctcaaaaattaatatgtttttccttatttttttggtgaaaactagaatttttattattattttcctgattttgtccatttttttcaaaaatttcaacatcaatagtatcttttttgatatggataatttgatctgcatataatcttgccatctctaaattatgacttacaaccaaaattgtcttgttgctagataatttttttaaactttcaaagactgctattccgttttctctgtctaaattcccggttggttcatcaagtaaaataaagtctgaatttcgcgaaaaagcacgtaaaatagcgactctttgcttctcgccgcctgataaatcattagttttttgttttaattttgaactttgaatattaagaaaactcgcacttttttcaagtaaatttaagttagtttctttttgaattaagctattgccaattaaaatgttatttttaactgaaagctgttcgattaagttaaaatcctgaaaaactacatcaattaaaggatttttttcttcttttccatctttaaaaaatagaatttcaccctcatcttttttagtaaaaccggcaattaaattaattaaagtagtttttccaatcccagattttccaattacaaatgttattttatttgatggaatttctagattaattttgtttaatattaaacggtccgcaatttttttacttaagtttttaatttctatcattttaaaaaattatttttaatacaattattcgaaattttaattagttgttttaatttttttaatagtaatttaaataattttaattaaattatcccataaattttatatttttttggttttttgtgtttttgggtcccttttcaaaaaaaaccttaacgttttgtatatatttcattccaaaattatctaaaaattatgcgattgatcttttgtaattagtccttaatgttagtaaagaaaaaattgaaaaaataagaaatcctgctaatcaaacaacaaaaacataaaaactgattatcgaatatgagggtagcacaacattttgccctgaaatccagtgataaatttcaggaattaaaggcatcaatacaacaaatccaaaaacaaaagctaaaacagagataaaaacacacgtcattcaatgataaagaaaaatttgtcattgtttggcttttaaattttttaaaagcctaattatttttctttttgaagatgctaaatttattgaataaaaaatcattgcaatcaaagaaatgattgataaaaacacagaaatcgcaataaaaaatcagcttaaaacctttattggtccttcaaaattgtctcttactgtcttaactggttcgagtttcttatattccggaaaagaatttcagaaatttttgatattttcatttaaatttttatagttaaaaaagatctttaaaaatataggtttaaaagtttttgatttctcaatgatagtgtggtgaaaaattacttcagttttaggaatagaatttttttcaattttatcgttaagttcgccattttgattttttgagtcgtaaaccccaacaattttaaagtcaaaattttgccctgtatttccacttcatgaatacacaatgttgttgattatggaatttttattagaatttataaaattttgtaagttacttgaaattacaatttcatcagaattttttgggaaatttccttctaaaagtttaaattttttaatttcaggctgactttcatagtaaattttgctaatttgcgccttttttgaattccctgactctaaaaatgagaaaatttggtcattttctttattcaagtttttttgcttatttttaataaaagtcgatttaggaagattaaagtgaacaaaactcaactgttgatttcattgattagaagcattatttattccaacaatcaaaagttcttgatccatcctaccatttatatcatcaataaatttaattttttttccaatggggttttcaatttttaactcttttattagtttagatgaaataataatttcattctcatttctaataaatctaccctgaaaatcttttgtgccaggcttgaatcttttactaaaaaattcggattcatcaacaaaatcaacatacccgtgactactttgttgaccattataactaaaactcatatatgtaacataaaatggtaaaattttagcaatatttccacctttttcttcaatttttttaatttcttcaacctcaaattgatttccaggaccttttcatattgaaattgaatctaattggtgttgaaaaatttttgacttgctaacagcctcaacctttgaagttaaggaaaaatagctaactattccaaaaatagccataaaaaaagcaaaaataagtaagattgtagaaaccatttttaatctaaaatcagcaaaaacaagcaaaagaccagttttgaattttgttgaaaaactaactggtttttgttcaatttttgtttcaaaatcaaaaatttcacttttgatttcctcgtttttttcacaaatttcaatttcaactgaattattttttaagtgaattatttgatctgcatatttttttgcaagatctaaattacggctagcaaccaaaattgtcttgtttttagataatttttttaaactttcaaagacagcaatttcattttcctcatcaagatttccggttggttcatcgagtaaaataaaatctgaatttcgcgaaaaagcacgtaaaataccgactctttgtttctcgccacccgataaatctttgacttgttgatttagtttttcattttcaatattaagaaaatttgctcttttttcaagcaaattttgatcaaattctttttgaattaagctatttccaattaaaatattatttttaacagaaagattttcaattaggttaaaatcctgaaaaactacatcaattaaaggatttttttcttcttttccatctttaaaaaagataatttcaccttcatcttttttagtaaaaccagcaattaaattaattaaagttgattttccaattccggccgcacccacaataaaaacaagtttgtttgcaggaattacaagattaatttttttaaaaattcatttattagcatcttttttatttagatttataatttttatcatttttaattaaattattcatattttttacttttagtaattcataatcatattttttaataaaattttgaaatttttaattttttaaaagttgtacaactggttttctataagttcatagcgaagttattatataaattaaagttaaaattgtaaacattatggctcaaataattgaaaaaacaaatataacctgagtatatgagggttgggcaaaatcctgatgagagattcctttataaatttcaggaataattggaactataaaaataaagcctaaaaataaaactgcaaaggataaaatcaacaaatcgagccaatgataaaatagaatttttttggtttgggcacctaaagcctttaaaattcccactgtttttcgttttgatcaacataaatttcttgcaaaaaatccaataaatatagagaaggtgatagaaaaaattattaaaaccccgaaaagaatcaattgcagaattattttagcattaattaataatccaagggttctttctgcaccaccatttattaaaaaatagggatgatttttttcaaaatttttaatattccggtataaatcatcgtttgaaaagtataacctaagtgtgtttggtcttaaggttttttgcattttttgaatttgatgattgagaacaacagttccaaatctaccatcaactgcaccatttagttgtttttcaggttcaaaaaccccaacaattttaagaaccacattttggttggctaaatttgtgttggtctctaaaaaatcaccaattaaatttaacgaatccttcccgataaaactataatttgaactaatagcgatttcatcataattttttggaaaattgccttttagtaattttagtttactaatttctggttggttatcgtaataaaatttcgaaacttctttttcttcaccgtctcgaatttcgtgaacttggtctacccgagccgttttataatttttaccaattcaagaaatcgactcaaaaggttctaatgtttgatttttcaaatattccttttcaaaaatcgatttaattaaattatgatgtaaataagaataagcaaaattttcaactagtttattatttactccaactatagttgcttcaatatgcctgaattgattaagatctaattctttgttttttttatcaatttttgctaaattatagtaaacaacattaattttctgcccaattgggtttttaatttttaatactctaacaacatctgttgatattatgatttcattttcatttttgataaaattaccatcaacctcttttgtataaagtcgttttttaaaaaaatttgactgatcaattggcataattagattgtcaattgcaagttttttagaataaaaaaaaccaatatttctcattaagttttggtaatccggtattaatttttcgatttttgaattattttttacaatctcttgctgatcttcctcggaaaaaggaattcctataaatggtctatttataattactgagtccatactatattcctggaccttagacaaattgagattttttgcagaaatctgtagtgaagtgaacaatgtgcccccacttataaaaacaaaaaaaacaataattaataaaataaaagttgttatttttgttttaaaatcggcaaaagctagcaaaaaaccagttttatatttcgttaaaaaattaaaaactggtttttgttcaatttttgaaacaaaagcagaattttcactctcattttcttgtgtttttttctttttgtcaaaagtttcaacatcaatagtatcttttttgatatggataatttgatctgcatatttttttgctagttctaaattgtgactaacaaccaaaatagttttgttttttgataatttttttaaattttcaaaaacagcaactgcattttcctcatcaagatttccggttggttcatcgagtaaaataaaatctgaatttcgcgaaaaagcacgtaaaataccgactctttgtttctcgccacccgataaatctttgacttgttgatttagtttttcattttcaatattaagaaaatttgctcttttttcaagcaaattttgatcaaattctttttgaattaagctatttccaattaaaatattatttttaacagaaagattttcaattaggttaaaatcctgaaaaactacatcaattaaaggatttttttcttcttttccatctttaaaaaagataatttcaccttcatcttttttagtaaaaccggcaattaaattaattaaggttgattttcccatcccagattcgccaactacaaaagttagtttgtttgtgggaatttctaaattaattttttcaaaaatcgatttagtttcaaactttttacttaagttattaattattatcatcttcttcaggtaaatgcccgtatttttcttcgatataacgacctaaaatatcaggaaatgatgttttaggttttctttttcgtcgtgttgtaatcattgaattttcagtattaaacattaaaaattcatcttcagtttctattgctcctactccatattgcccatatgaagttactttgtatctccaacccgtacccgcataagttattttagcttgtggtaggttttgaacacttttagtaataaataattctctagttccataatctattccaatttttatacctaaattagatctgaaattaccattatattttatttccccgcctacctcaaaggaagggctacctaagcccgaggttcaagtttttaaggttgcttcaatatattttggcttacttgttatataatatggacttacttttttttgatgttttactgttaaattacttgctcatgcaactttatcttcccaaaataatccaccaaaataaactatggattttgctccgagaagcgagatttcccctgcgtaattatcttgttcaatttttaaatatttatcatctacatatttttgggctagcgcgaatgaacttaacgatttaaatgggtccagagcagaggaaaaaattgtagaagctattgaacttgcatttttaatattttctttgcccgaataaaacccgtttgcattttcatttctaatagaaattgttgttgtggttgttgtaagaattgtacataaagaaccaaaaattccgaaaaataaggatattttttttagattcttttttagattttgcattattactaattcctttcggttttataagttaggtttgttgggttttaacttaaattttactatgcaataattttaacaaaaaaaaaaaaaaaaaaagtaaaaataaggaaagaagaatatttataaaacattgaataatattgaattatttgcaaatatcagaataaaaggtcacttctttactaaatcaaattattttactatagaattttatattaattagtatgtttgcctcaaattcaacactttttattataaaatcaaaaattaaaattgtttttttatgataaaatatcaaagaaataaatttaataactatgttaaaatctaaaaacttaagtaacaaatttctaaaatttattaagaaaaatcgcttaattattggtgttatttttatttttacttgtgttttaatagtttctgcgctttttatctttgtctaccaattaataaatgtcgaaggaaactcaatgtttccaaccttaaaaaatggccaacaaatttttattaacaatgtcaaaaaacctcagcgaaatgatgtggtagttttcaaatataaagataaaattttaattaaaagattggctggaattcctggtgataaattagaagttactgaaaattctattttaataaatgatgaattagttgctaattttactgatttaggtttttggaaatttaacggagttattcccgaaggtaaattttttgcacttggtgataatataaattttagtaatgatagccgtacttttggcttttttgatttaaatgatattaaaggtgtttgggcctaaaagctgtttttgtggttaaaaatttgccaaaattttaaaaattttatatttatgttaattgttatactatattttttcagaaattaaccaacaaaaaaatttttagttggttaaaaatttaaattttttgatttttaagaaaattttagtgtataatctgttatttatataaaaaataataaagaattttttgggggagaagtggacaaggaaaaaatattaaaacttgcaaaatctctctattttgtcccaaatgagaaggtaatttatacaattttaactgaaaaagatcaaatgttagctcgaattaactatttgcaccagtttgatacaaaaaacattcaaccacttgaaaaaattaactcactgccaaaaggtatagaaattttatttgaggatattccagcttttaccagttttagagaacaactttttgacaattctattcatagcagtgaaaaccaaattataattaaaaaggtaattgatgactaaatttcagcttagttttcaaggagcacttgagaaattaaaaaatgataaaaataatacggttgcttacttttttcaagaaaaaaacaacaaaaaaggtgttttggcaaataaattttttagcatcaaatcgaattttgcaacaactgaaggtgtttctcatgcttcttcaatttcccttttaaattttaaaccctcttataatgcaactgtttttcaaaaattaattaatgccggagcacaaccacttgtaaaagttcataatgacgagttgggtttaggtggaaaaggtcttttttcagctttcggtaaaattgtaaatcctttagacaaaacaaaattaattggcggatcttcatctggaagtgccgcaacaattaattttgttcacttcgcaattggctcagacaccggcgattcgattagaaggccggctagttttatcgggaaagttggatttaaaccttcatatggtgctgtatcccgttatggattgtttccttatgccacttcgttggatacagtagcgtggttaactcataatgttctggattctattttagtatcacaggtagtttttggttctgatgaaaacgacttaacatctgttgaaatcgatgttaaaaatgttgaaaaaacaaaaccaaaaaaagttgcatttcttgatttggatgctgaaattgaagattatgtagtaaaaaaactctataaattacggaatattttaaaatctgaccaggtagaaatagagataattaaaccagatttaaacctattaaaaacaattctacctgtttatgaaataatttcttattcagaggcaacctcaaatttatctgcaattaatgggataacttttgggaatactgaaaaaaatttaaaatgagaagagatttttattagaacaagatcagatggttttggtttgatgctgcaaaaaagactaatttgaggctctttttttcttgaaaaagataatcaagagcatttttttattaaagccaaaaaaatgagaactttaattaagaattattatgaatctatactgaataaatttgatttagtagtttttcctgctttttatggcattgcccctgatattcaaggtgaaaacagtgaaaaaagtgataaaattactaattttattctagctatttcaaatttagttggcaatccatcaattagtttgccattaggtagttataaaaatttaccttttaatttagcggttgattcaaaaataaattctgatgcagaattgttaggattttccctttatcttgaagaaaaaataagcgaaattaataatgaataataaatatttagtcacaattgggattgaaattcatttggaattaaatacaaaagcaaaaatgttttcaaattcaccgaatttacgcggtgaagcaaatcaattttttaatctttttgatctagcttatctcggaactttaccaaaaattaataaagaagctgttaaaaaagcaataattttggcaaaagcactaaaaatgcgaatttcaccaattttagcttttgatcgaaaaaattatttctaccctgatttgccaaaaggttttcaaattagtcaacaattccatcccattggaaaaaatggaattttaaaagttggtgattttaatgttgaaattgaaagaattcatcttgaagaagatacggcaaaacaaattcataaagataatcaaacattttttgattataatagatgtggggttcccttgattgaaattgttacaagacctgtaataagttcatcaaaactagcagcaaaatatgtcgatgaaattaaaaaattaaccttatttttaggtatttctgatgcaaaattagaaaatggatcacttcgtgctgatataaatatttcagttcgccctgaaaatcaagtcgaatttaatccaaaagttgaaataaaaaatataaattcaatttctaatatccaaaaagccgccgaacttgaaattcaagaacaaatttatgcctatgaaaacggtataaaagtcaagcaagttacaaaaaaattcaatgatgttattgcaagaaatcaaattttaagacttaaaacagatgcaattgactataaatattttccagaacctaatttgccatatattgaactaaagccagattttgttgataaaattcaggttccacttaccccatcagaaatagaaaaaatgcttaaaaaagaaggagtttccaccttttatattaatcagatcttgaataattttaactactgaacctacctaaacaactccaatcctgataattgaagtttaagtgttaaattatttttttctgaaattgtaccaattattaataagctagggttcgaaaatttagcaatagaatttgatttttttgggaaaataatccaaaaacattttaacaaagaattgtcaaattccgaaattcgcaaaataattgaaataaaacaaacaaacaaacaatttaatttaaatgatattttatctaacataaaggagaaaaaactatctgaagcagcaataaaaaacttgttaaaagaagtagttagtgaagaatttgctcagattgaaaaaaatagacaggataagtctaaattatttaaatttttaataggaaaattaatgcaaaaaacaaaaggaaacgccgaaccaattaaagtcaatcaagttttaaaagaatggttagatagttttaactaaaaaataagtaagatattacagagacaaaattgttggttatttttctaggtaaaactcaggattttccaaaaaaattaatttatttttttgaaaaattaagtaaacctttttcattaaaattttagtgattcgtaaaaaccagttaaatattaaaattttaaatgttttttaattttagtagtcgacaaaatttttgatttttttaaaaaatcgcaaaaataaggtagaatttaaatatgtataaagctgagataaaaagattattaatttcacttaaaaatttaacaataactttaatatcaattcggggtgttaggtttgttatagaaattatttggggtattatggcattctgacttttaacaacctgactttttactgcctcttcagaagatataactgatcctaaaatttgacaagagaagcaagatgcagttaaaaaccaattatttaggttttcagggccacaatttattttgcttcttgttttaatcgggctaattatagcaaactgaattttttatataatgttttttataaagttaaataggcttcaaaaacttcacttttatattcaaaacccgataataattgctagattatccacaattaagtcatatactattattggtttttttgttgggtatgttgatttggtagcggctatttttgctttaaaattagttgtatcagattgaagaagactaacagaacctgaacaaaagaagttagaaatttaaaattatcctttaatttatgttattttttaaaaatttgtcgtatcttttgggaataattttcaaaaaataagttagaaaaaattcattatctaataaattaataaggactgagattattatttgtcagccttttcttttggttgttttttcattcttcttccatcaaaattctttaaaaaattaataagatgaactaaaacaataccaattggtccagaaaaaataaataaatcagcaaaattaaatgtaccacttgagggtaaatatggtaaaaaaagcaaatcttttacggtattattgtttaaaattcggtcaatttcgtttcctcagttacccgctaaaagtgttgccataaagatagtgagtgaaaattttctactaaaaggtattaaaattaaaagaatcgctgtcaaaaaaaaagcaaaaatatgaattcccacaaatccaatgattttgttaattttagaagttacaccttggtgcaaaagtggccgaaaaccaataaaacctcatgaaatattttttataaagccttttttggttgaaatttcgtattcatctcaagtaaaaattaaattttttgttaattggtcaaccaacaaaaaaactaaaataattgaaaaaccaatgataatatttaaaataaatcgtttttttccaacaagttggtattttgttttggtaaaattaactatttttttcaggtacaatttcacttaaaacctcaaaacaacgcgcacatactttgtttattttttcaaaatgattccaacatcttgggcatttttctcaatttagttgtaaaatttccgtttttccattagaaaattcaacttttgcaaccattaacaacttcttaaggtcgattgattttataaagtctgagtcagtttttagtaaaacacctacttcatttggtcgtttaatttcctttgacttaattttttgctcaattagttggtaaactgaatccttaatttggaaaaattcgtttcattttgcgtctaattcttcatcaaaatgtgactctttaaagaattcttccatatgaactgaaatttgcttgttatttttttgtataaaactgtaaatttcttcggcagtcgttggcataattggtgcaattgcaatatttaaaacctgcaaaagttcatataaattatactgaacttgccgtctttttaaggactcttttttatctgcgtataaaatatccttgacaattgaaagataaaaattcgaaaattcaataataaaattattaataattttgacaactcgaacaaagcgattttgatcataattttgaataatttcgttttttaatttttgaattttattgaaaatatataaatccacttcagttaattcgtattttgttggcttaaaatcggctaaattggtgattaaaaaccttactgtgttgcgaattttgcgataaatttcaacattttgctcaaaaatcgcctcagaatacacaatatcattataatattcgctgtttgcaactcaaagacgaaaaatatcgcagccatatttgcttaaaattaagagtgggtcaactccatttcccctggattttgacattttattcccctttgcatcaacaacaaaaccgtgagaaagtaattttttataaggagaaaatccaaaataaattacagaatttatcaaagacgagttgaatcaaccgcgatattggtccgaaccttcaaaataaatatcaaaaggaggtttttcatcgctaatatttgcagcaaaaaaactaacaccggaatcaaatcagacatctagaatatcattttccttagttcaacctaaattttggtacttttctggtaaaagttcatcagtagttttttcataccaaattctagaaccaaatttttcaacaagtgaaattatataatcaaaaatttctggcttatcaaggacaggatctttattttgatcatagaaaataatcaacggaattccccaacttcgctgacgtgagatcagtcaatcttttcgttcgactaccatttttgtcagcctttttttgagtcaattttccgggaattcaatttcttctattgctttttcaagatcttttttaatcttttcaattgagacaaaccattgcggcgttccgcgataaattaccggttttaaagttcttcaatcatgtgggaatgagtgatctataaaacttaggtgcaaaatttttgactttttttctaaaaattctgttattaatttattggaatcagcataaaactgcccggaaaattgacctgcattttcattaaattttccatcatcatttacatgcattaccatttcaaggttgttttctcttccaattcagtagtcatcctcaccaaaaagtggcgccaaatgaacaagtccagatccaacatctaaacttacatggtttccagaaacaattggacaaattttttcaaaaattgggtgaagatatttgattcccaaaatcgcccttccaggaaaattatctataatttcatagtgttttcagtcaaaaataacagctaatttttctagtaaattagctgctagaacataaaaattctctccattttttatgcgaacataatcaaaattttctccaacagcgactccggaattggcaattaatgttcaaggtgtggtggttcaaattattaatttatcattttcagcgacaaaattattacctttttttatatcaaaactcgtaaataaagacggtgaacggtattcaagatactcaatttcggcttctgcaagcgcactttggctacttggcgatcaataaactggctttagtgcccgataaacaagtccgcgactgaccatttttttaaataattttagttgttttgcctcataattaggcgtgtttgtttggtaaatttgtttaaaatcagttaataaatttaactttttaaactgcttcatctgtgctaaaatttgtgaatttgcaaaatcatttgattttctacggatttctagtgtcgattttgagccaatttggttgataattttattctcaattggcagaccatgagtatctcaacctggaacaaaaggtgaataaaatcccgccatagttttataacgaacaataatatccttcaaaattttattaagcgcatggccaatgtgaatatcaccgtttgcatatggtggcccgtcgtgtaggatgaaccgcggatttccgcgtctttttcttaaaatttgctggtaaatctgatttttttctcaaaaatcagcataaaatttgtctttttctgacaaatttgctttcattgaaaaattagaattaaaaatatttaatgaatttttataaaaatttttatccattatttgtcatccttttctatttttttcagaattaaatcaatatcaatttcacttactttccgaagtttttcttctaaagttgagtcattttttgatatagaattttgatcattagaattgctttttagcaaaaagttgttgttttttatgtggttttttcccgattgaatatttggtaaaaagaatttataatcttttttttgattagtttttagctttctaaaatcatttaaactaaaaatttttaatccttctccaaattcaaaaatttgcaaattttcgttataaattattatgctttttgggctcagggaaaaatcaagctttgttttaaagttttttggagtaagaattttatttccaaaaaacaaattttcagtattaattttttcaaactgtgaattaaagtcaataactgcaagtgattctgagctttcaatagtttgactggcactgataaattcattttttcggtgtctgaaaatttttatacctgtggaatttctagtataaattggaatttctgatatactcatttttagagcgcggttttgtgtggtaattagaacaatattttttaatttttcttctaaaaaaacactaattagctcatcaccttccttgaatcgaaagatattttgtaattttttttgcttaattttcattaattggtccaaattcattcttttagcaaaactgaatttggaaataaaaattaaaaattgactactttcaaaactatcagcaaaaaaaacacttaaaatttgttgattatttgggattcctaaagttatttttaaattattaggtgagtttttcagatttaattcaggaatttgatgcacagctaaaattgctatttcccctttattagttagaaaaactgctttttgtttttggttaattataccttgaaaaatgaaaaaatctccatttggaagctgagttttttctatttcatcagggagagaattttttatatctaattttttataaagtcccgattttgttattcaaaaataaaaaaactcatcttttactaattcatctttgttaatttttatcttaatatcagagtcaattatcctagtttttcgcggttttccgtgatgttttttaaaatcagttaacatatttattaaatttttatcaaattcatctttattttcaataagttttttgaacttagtaatgtttttttctaaattttttgattcttcaaggtaaatttgctgctcaattttcgaaagacggtataaacgcattgatgcaattgcctctgcttgggtttggctaaagttaaaaaatttaattaaatcattaactaccccaacttttgaattatcagatgcgcgaataaccttaataacttcgtcagtaatatcggcaactttgagaaacccagtaataatttctaatctttttttatttttgtaaagttcaaaattaaattcggcaagcttaatttttcttaaatgctcaagatagtaaaaaatcatctccttgattgacaaaagttttggtgaattatcacaaattgcaacggaattataagaataatgtatttgtagatgagttttttgtagtagataattaataattaggtcaggatttccgtcctgttcgagttcgatcaaaatggaaactccattttgatcggattgatcaattacatttttaatcccataaatttttacatcaaaacgaatgtcatcaatttcttcgattaaacttgactttgaaattccaaaaggaatcgaggtaatttcaattacattttgcccatttttttcgaaaattttataatcagagcttatttttattttgccttttccagttttgaaagcatcaaaaatacctgattttccataaacaattccgcctgttggaaaatcaggacctaaaattatagtagaaatttcttcaattgtaattcctggatttttaatcatcaaaattgctgcatcgatcacttcgcctaaattatgcggggggatttcagttgcaaatccacttgcaattccaattgccccatttattaataaatttgggaaaattgcaggtaaaattgttggttctttttcactatcatcaaaattagggcaaaaacttacaacatttttcgaaattaattcaagtaaatgctcactaatttcagccaatctaacctctgtatatcgcatcgcggcaggtggatcgtcatcaattgaccctttatttccgtgcatttccacaagcggagaattcatttttcattcctgggcaagtctgacaagagcatcatagattgaagaatcaccatgaggatgatattttccgattacatcaccgacaactctagcagattttttgtaatttttactattttttagccccaactgtcacattgaataaagaattcgcctctgaaccggttttaggccgtctttgacatctggaattgcccgttgttgaattacatattttgaataacggataaatttttctgctaaaattttttctagctgggaattaattactgaatcaagacttttattcataaattgtttcctttaaattttcaataaatttgtcttcaagggaaaaattaacgtttttttcaattcagctctttcttagatcagctctttcccccattaaaatttgaaaatttttctctacttttggataattttcaattaaaactttttccaaagttcgcctctcggggtccattgtcgtttgccaaagctgatttgcattcatttccccaagtcctttatagcgctgaatttgcaaatttgtactgtttttgatgtatttttcgaacttttcctcatcccagatataaatatcttttctccccttttcactaattcgatataagggcggttgagcaatatagacaaaacctttttcgattaaaggccgcatatgcaaaaaaagaaaggttaaaattaaaatttggatgtgggctccgtcattgtcagcgtcagtcataatgataattttgccataatttaggttcttaaggttaaaattctggccaattccagttcctaatgcactaataattgcgataatttcctcattttttaatagatcaattaatcttgttttttgggcgtttacaattttaccttttaaaggtaaaattgcttgaaactcacggtttcttgcaagttttgcagaaccacctgccgattcaccttcaaccaaaaaaagctcgcgattcatagctttttttgaatttgctggggttaatttccctgataaaatccgcttttcttttgtaattgatttgcttgtttttgactcaattatgcttaattttgacttttgtctttgggtataagtttctagtataaaattgattattttacttgcaacttctttatttagtgcaaaaaaagtcattaaatttgtaaaaattacctcttctgtaactgtttttgctaaaatagttgataatttattttttgtttgcccaacaaattcaagaattgattcaggaattcgcagtgataaaacagctgaaagtccaacttttgcatcactaaattctaaaatttgcttagttttaagtaaattattttgttggccgtaagtattaattgcctttaaaaaaccggatttaaaaccattttcgtgacttccccctaaatttgtttttacattattgacaaaagagataatattttcttgctgtgaattaacatactgaaatccaaattccactatgatttcctgcattttttctttaaaagtaataactttatcatgaattttttcttgatcattgttcaaaaattcaataaaactttcgattcccctttcgcagagaaactttttttcaatattgttttttgtatcaaaaaaattgatttttagattgttaatcaaaaaacaagtttcgcgtaggcgcgaaattatcatttctgagtcaaattctgaatgtgaaaaaagggaaaaatcaggtcaaaatctgatttttgtcccagttgtagcgctttttcctataattttagttcgagtttcaatttttccaccgttaataaaactagtatagaacaattttttatcccgatttatatagacttctagtttttcagaaagagcattaacaactgaagagccaacaccatgaaggccaccagcggttttgtagatatcagtagaaaatttcgctcctgaatggagctcgctaaaaactaattcaacgccagtttttccggtttttttatgaatttctgtcgggattccgcgcccattatcactaatttcaatagaattatcactattaattattagtgaaatttcatttgcaaatccagcaattgcctcgtcaattgcattatcaaagatttcccaaattagctggtgtaatccgtttttatcagttgatccaatatacattcccgggcgtttgcggaccgcttcaagcccttttaaaagttttaatttttctactgagtaggtcatatagggtctaaatcctttctgaaaatgcgtaaaaatttttctaaattaaattttatacaaaaaggtaaataattttacaaaaattttaatgtaaaatttaaaaaaagtggtaaaattactaaaaataattaaattttgttaattttttgtttttttagtaccaaaactcaaaatagacaaaattaatataaaagaaatggagattcgcaatgaaaaaaatcgcaattaatggctttggacggattgggaggttggcacttcgtcgtctttttgaagttaatgatgaaaatttacaggttgttgcaattaacgacttaacagatgcatcagttttagctcatttatttaagtatgattccgcccatggaaagtttaacggtgaagttgaagttttaaaagataacggaaaaaattaccttaaaattaaaggtcaaaaaattcttgttttatctgaaagagacccaaagtccttgccttgaggtcagcttggaattgatttggttgttgaatgtacaggattttttgcttcaaaatcaggagctagtcaacatttagaggcgggagcaaaaaaagtaataatttctgctccggcaggaaatgatgttaaaaccattgtttataacgtaaattgtgatacaattactgaagatgatagaattttatcctcagcttcttgcactacaaacgcacttgccccacttgtaaatgcgcttgataaagaatttgggatagaccacggatttatgacaacaattcatgcttatactgcagaccaaagattacaggatgctccacatggggatttaagaagagctcgagcggctggagtaaatttagttccttcatcaacaggtgctgcaaaatctattggacttgtagttccttcccttacaggaaaattggatggaattgcaattagagtcccagtgattacaggatcttttgttgacttaagtgttgaacttaaatcaaatccgtccatagaagaaattaatcagaaaatgagagaatatgcaaacgaatcttttgcatattgcgatgagccaatcgtttccagcgacattattggtgacagacacggatcaatttttgatgcaacattaacaaaatatattgaagcaaatgggaaaagactctataaattatatacatgatatgataatgagtattcattcgtgtctcaatttgtaagggttattagagattttgtgcaaaaataacaaaaagtaagtaacaaattttgttaccaaaagtacttaaactaatataaaaatccttaataagagtttaagttccttatgaaagcaaaaataagggggtgattttggtaagatataaaagagaaaaaattaaaaaaatcctaaaaatacttagtattttcgggattttttctctttcttcttgtaattattatagttcagttcccttagttaataaaattaaaattcaaaattcaattccttacaatgataaaactgatttaagtcagactgtttcagaagataaagtacctgaaaaaaaagatttttttgttgaaccaaaagtaaaaacttcgaaattagatttaaatctcagtacaaaaaatcaagaaaactccaaaaaaatcgataaaaataatcagtatttttctacccaaaaagatcaaactacccaaaaagatcaaactacccaaaaagatcaaactacccaaaaagatcaaactacccaaaaagatcaaactacccaaaaagatcaaactacccaaaaagatcaaactacccaaaaagatcaaactacccaaaaagatcaaactacccaaaaaataaccttattaccgcaaaaaaagccaataaaaaaagttattgtaccccctgtttcacctgttgtacccgaagaacagcttaaaaaacaagtcgtacaaccttcaatttcacctgaaaatttaagaaaccaacctaaatcaatctcagataacgggaaaattagccctcctaacttagttagttctccaaagacaaaggatcagatttcgctaaaaccacaagatcctaaaaaaattgaaaaaaaggctataaataagttcgatatttctaaattatctaaatataacgataatgaaaaagtgcaaaatattgttttggggaataaaaccggaatatttaaaacatttaaggtgtccaccgataatgcaattttgcgtgaaaacggcgagtcattttcagggtcaaaaaacgaaggtttaaatatttatctactagataaattggataaaaataaaatagataagaataatccagttcttggattttttgttaattattttaataaaaattttcgcaaaaactactataaattaaatcattttggctttaaatcagttgattatgctgataaaagatacaatgaaatttatcagagaaacgtccgcttcagttcagggacatcaattttacttgatatgaatagtgaggaggcgctttttttaacaaataatcacgtattatttgacaaaaacaaccgtccaatgtgggctttttttggttacccatttatacttttttattttaataatcggattaattttattccttcccctgattattcctgggttttggacactctccaaattaaagaagaatatgagaaaaaaggtaataaatttcaaaaaaagtcgaattcaaaatctaaaccagaatttgttaaaaaaacttacgaaaaatactttcgacttgcccctgattttaacagaaaaaataaagatcttggacttttttactttaaatacaaagaatttatagctgatttttcaacggcggttaaattttttgaacaacatcaaaacgaaattaaaactacttttgactgagcaaaacggcaagatacacaaaaaaggttaaaagattttgaaagagctatccaagtttttagcaaatattttgagcaaatgtccaaattaggtcctgttaaattaagtgaaagggtctgaaaaaatggagatatcgactatgaaacaaaattaggcctattttggccgcgtcatatagctgccaaaaatatgttcaaaggggtttatatccgcgggcaagaggcaactttttttgctacaaatggccatggcgcatcgggaagtgggatttttaacacagatggttcgcttgcgtttgtaaattatataatagttaaagatacggcacaaaagtattattatagtgatcaaaataatttattcaattttcttacagccgcaattgctttaaagactccttatatcaatttagttgatgaaatttataaattttattataataaaaatgtaaggaatactttaaaataaagaattttttgcgagtatacttggcttatctaaattttttattttgcacaaaaatggaagattaataatttttttaaaaaaaaagtgataaaactgaattttaggctaaaatagcactaattttaccctctcaaacattaacactttcaattttaatatcaataaattcgcccaatttaaatcttcgtctgctattataaatgcaaaacccatcttctgtcaattggtatggatcattttcgttgtttgggagacttttattacttaacatcgcatcaaaaagtccgttaatttcaacaaaaaaaccagattttataattgaagttatttgggcattaaaagtttgaccgattaatttttttacatattcagttttttttatattgacaatttttctttctaaattaaaggctttttgctctagttccgtggtcaagtaggaatttttagttaaaatttcgttgaaaaaatcaaaatttttgtttttttcaaagataaaaaaacgaataattcgatgtaaaattagatccgggtagcggcgaattgggcttgtaaaatgggaataaaaattcgctgccaaaccaaaatgacctatgttttccgtgctataaattgctttttgcattgttcttaaaattgaatattttaaaaaattatcgttattttttgtttttatttcatcaatttttcttgcaaattcccttgaatttgagtttaattttaaagtattcttaactcctaacaccttcaaaatttgattgaaaatcataattttttcaggatcaggcttgttatgaaccctgtataaaattggaattttcctttttgttaagaattcagagacattttcattagctctaatcataaaattttcaattaattcttctgaggttcccctactttttaattttaaagattctgtaaaaccttgttcatccaaaataatttttatctcatctatggccaaatcgatataaccttgattttttttaaacagtgataaaatggtgtttaattcttgtgctgttttcaacattttttctaaattagtatcgttaaaactagattttccattaaaaaaattattgacatctttgtaagtcagtcgccattttgagttaattactgatggataaattttaattgataaattttcaccccttttattaattaaactttccattgttattgtaaatcggtcaacattcggctttaaagagcaaattccatttgataattcttcgggcaacattggaatgacggtgtgaggtagataaattgatgttcctcggcgttgggcttcaacatcaattggactatcctgcttgacataatgggcaacatcggcaatatggactttcaaaagaaaatttccttcatttgtttttttaacagaaattgcatcatcgaaatcttttgtatcttcgccatcgattgtaataactaattcatcgcgcaggtcggtcctgtttttttcaatattagtaatttccttttcaattttttcagcctcttcaagaacatcagcactaaatttattagaaacttcagattcaattattggaatttttacatacaaaaatggctcgcttttatgaccaattttctgaattatgcttatttttaaagtatttttttgatagtcaataatttttaccttataataattatcattaattaaatcatcagttgtgtttcaacggaacaaaaaatcacctttaaaatttacaggttcaaaatctcaatatttcccatttttaaaagcttttccgattaaaaacttgttatttctttgaataattttggttactataccaaatacctgatcacttttgaaacgatcagcataaatattaattttaacttcatcaccttcaagggcgctcgctgtaaaacgcccggggataaaaacgttatttttctggattggattttctttgtcttcaacaaaaccaaaagcagaattggttgctctgaaaattccagatgtggttttgagaaatttaggagcataatattttccttcaggggttttaaaaacaacaaaattttcaattagattactaatttgattagttagctggtgatttaaattgaaaggaatgttaaattttcgaacaatttcaataaaagttttttcttgacgcagaaaattttttaagcgctcttccgatataatttccataatatttataataacctaacaactaaagcgagcccgagaaagataaaacccacaacaaacattgctcattttgtgaattttttaaatccgcgttcttttgaaatctggaataaatctaggtcgctagaaccaataagcgctcccgaaaaagagtttgaatgtggcgacataagcagtgagattaaaataattaaaacaccaaaaatggcaataaacgtaacgatgattgttcttcacataattcaaaaacaccaataataatattaataattatactataaattagacagttttatataacagtttttaaaaaaaatataaaaaaacgaaggataaaaaaaacttttgataccttattaatttcaataataatattttgattttttagtacctgaatataatttaaaaagtcacctaaaatttttcctttaaaaaataaattagtttcatattgaaaaagaagcgatcgataatctaaattcgaggttcctatcattccatatttatcatcaatgattattgactttccatggaagaaaagttctttaaaatagtgtatttttgctccatatttcaataattttttagcaaaaaaatcattgaaagttttaataatttttgaatcatttctccccggtaagaaaaaattaacctcaattttagcaagcaaaatatcctttaaagcatcaataattttttgcgagggaacaagataaggggtaaaaatttttatatttttttttgctgaataaattttttttaaaataaaaccctcaattaatgagtgctcgaggttgggtccattttgaataactacaccaagattatcgtttttgtcttgctttagattagaattttcaatactgcaaaatccattgattttttcttttgatatcttttttttgcctcattttgttcaatggaacagaaaatttttacagtaagtttgaacaatttcaccttcaagtctaaggtttaaatccattcaatatccataatttttatcaaaacttgaatattcttcggatatattatttccgcctgtataagcaatttttccgtcaataatataaacttttcggtgatttcggtaaaaactttgtccggaaacaaatggaattttaaaggtgttaaagtgcaaaacctcaattttttgcttctttaattcgattcaatggcgcctttttataagataggtgccaaaagaatcgactaaaattttaattatcaccccgcatttccgcttatcaaccagtattttttttaatttttttcaaataaaatcattttttattatataaacatcaataaaaataaatttttttgcatttttaatgtcagcaaaaagtttttcaaaaaaactatgaccatcaactagcaaatttccattaaattctttaattggggatgaaaaatattcactagaaaaacttagtaaagtatctttagattcttgatttttccaggtttgaactttttcttttaggttagtaaaatttctgtattgtgcaaaatattttttaatattttgactttttaagtattttctgcctaaaaaaatatatgaaattgggcctattattggcaaaattgaacaagcaattaatcaagaaattttcgtttcataccttcttttttgtaataatataaataaattaaaaaaagaggtagaagcataaactataaaaatagtcaaaattgaaattcaattcatattctttgctaaaaaataatgaattaaataaattgtggcactaaaagcaactaaaaatattactaagaaacaatagtaaaaaaatcattttataaatttatgcattataataataattttactataatgtttgagattgttgttgattttcctttagtttttcaataatttgatcctttatttcattaaatagtttggtattattttcaagtagtaattttaaattcactttaccttgggcgatattctctcccttatatgcaaatcacgaaccttttcgtacaagaattccaagttcctcgcctaattgggcaatttctgctgattttgaaatacctttggcaaaaacaatttcaactaaagcagttttaaaaggaattgcaagcttattttttactactttgatttttacactatgcccggtgatgtcgtttccacttgttatttgttgaatttttctaacatctaacctgattgaagcataaaatttgagtcctcttccaccaggagtagtttcaggattaccaaaaattactccaactttttccctaatttggttaataaaaattacagttgtcccgtttttatttagagatgctgtgatttttcggagcgcttttgacatcagtcgagcttgtgctcctattacttgatctttcatttctccttgaagttcagccattggcactaatgcagcaacagagtcaactacaattagatcaattgcttttgtttttgttaatgtatcgacaatgtctaaagcttgttcgccagagtctggctgtgaaagtattaaattatcgatatcaattcctaaattttttgcatactgtggatcaattgaatgttctgcatcaataaaggcggcaattcctccctgtttttggacttcagcaatggcatggagactaattgtggttttccctgatgattcaggaccataaatctcaacaattcttcctttcggaaaaccaccaattccaagagccatatcgatagccatactcccagatgaaaaaacttctgtatcaattggcggcttttcacctaaaaccataattgattcgttaccaaatttctttttaatttctgcaagcgcttgttttaataatgatttttcgttaatttcagtcataattgtttcctttttttaatttttcggttttggtttgttgcttattctaatttaatattttttaaacattttaataaaaaaaggaaaaatttaggaaaaagtggccatttttcctttttttgaaaaaattttgtattttttcataaaatattatgctagggcggaaaataaaagtaaaaatttcagccctagtaataatttttattttaaaatttgaaaaatataataaaatttccagtatgaaaaaaattttgattggatttactaatgaatcattccgcgagggtaacaaatttatacaaaaaaaaatccataatggaatgaatcataaaatagattataatattttatcaaattttaattttgttccaaaattaattttaaattctaatgaaaaaattatttgggagtggattgatggcgaaaaagttgaaccaaaaattgaaacactagaaaaaattgcttctcaattaagagaaattcataattccaaccttgattttcctccctcaaatcattcctttcgggttgagcattatttgaaagttttatctgaaaaaggtataaataatacagttattgtaaaatattatgactttattaagaaaattcttcaaaaaatggataaatccaagccacttcataatgatttgtggttgatgaatatgattgaaaaagatcagaaaatctactttttagactgggagtatgcatcaaaaggtgatattcattttgatttggcttattttattgaatcagccaaactaaatagtgaaaaagaacgcatttttttaaatttttatggtataattaattatgaaaatcttctattacaaaaaattttagtattataccttataatattgtgagtgaatgcgcaagaaacaaaacattttgatgatacaccttatgcgaaaaaactagaagatttatatttggtttttgcatctcgaaaggaataaaatgcgatttgtcgactatgtttcaatcgaagtcgtggctggaaaaggtggcgatgggataatatcgtttcgccgggaagctcatgtcgacaaaggtggaccggacggtggcgatggtggatgaggtggttcaatttattttgttggtgattcaggtatgaatactttattacctttttatcaaaccaagaagattttcggttataatggcgaaaatggtaggccaaaaagacagactggcgctaatggaaaagatatttttataaaagttcctttaggtacacaagtttttctaaaaaagtctttaatttgtgatataattttagaaaaaaaatacttaatagccaaaggaggtcgaggaggtcttggaaattttcatttcagaaattcaaaaaataaggcacctcgaatttctgaaaatggggaattaggtcaaaatttttatcttgatttacaactaaaagttatggctgatatcggtttggtaggtaagcctaatgcaggtaaatcgacacttttatcactaatttctaactcaaaaccaaaaattgcaaattatgaatttacaactttagccccacaattaggtgttgtgaaaatttatgaaaattcatttgtaacagctgatcttcccggattaatccagggtgctagttcggggaagggaatgggaattatttttttaaagcacattgaaaggtgtcgagcaattgttcacgtaattgattttggttcagataacaaaaatccaattaaggattttatcgagataaaatcagaattagaaaaattcaataaaaagttattggatttaaaccaaatagttattgcaaataagtgtgatctacctaattttcagtttaatttagcaaattttaaaagaaaatttccaaaaatcaaaataattaaaagtagtttaatttctgcaaaacaaaacgaaattaatataattaaagagaaaatgtttggtttgttaggagaaaaacaaaaaaaattagaaattcaagagataaacacctcaaaaattgaatttaacttaaaagctccctttttaattaagagcagaaataacggtttttttgaaattacaggagaacttattcaaaaaattattcaaaaaatcccgctaaattctcaagagaacattttacgttttaatgcaaaagttaaaaaaattggactttgggatgaattgatcaaaaaaggaattaaaccaggggatttagttagaatctatgaatttgaatttcactggaattaaaattattttattagagcgaaaatcgctccaaatcaccaatattattcaaaaaaaatacaaaccatatgaaagtgaggaaacgcaatgagcgtagttgccaaaataaagaagttaattgcggaaaacccgaaagacaaagccgagtggtcttttgttgctaaaaaaacattagttgcattgttatttttatatcataaatcaactaaattaacttctcaaagagagaaagtttaccaaactttaggaatagttgaaaaaccaaaagaaaacaaagaagaggaagtttcagcgatagaacgtgcgctctcgctattggaacctaaatatacaaaacttttgatcaaagaatttattgacaacgattatagctgaataaaaaaatattgatcaaaatccacttattacaaaaatatgcacaatgcaattgaccaatttatcataattttaaacctttaatatatgaatttcgaattagctccttatgaaaatccggaaatccaaatagcaaggagttatgggcagatttcatttagttatgcatcaagttcttcaccaaacggaattagacagtttgtgaaaattgagcgtgatttatcttcggatcaatttagcgtgattgttactgttttttcaaaagtagccggaaaagttaatgtttatgttcaggttaataattctagtccaacagctccaaaattacttgaattattaccagaaaaattcaatcaagcagtttttacattcggagactttgggcaaacaaaagaaaaggccaatgagtctaaatttccgaaattagataatattttagtttacttaacaaaagaaaacgagcaaaaaatactattagataatgttttgaaggtgcgaaatttttcagatgtaaataaagaatattcgattaaaaaagcagggattggttttaagcttttaaaatcaattaaaatggcaaatttaggcgctgatgcctcaattgaattttcaaaaacttatgaaaaaattgatgaaaatacaatctatttttttcctgataaatttagtcaaaaaaaacacaatataaatatttttaaagttggtcttgatcctgaagtttttgaagctggcaatattgaaaaaaatattaatattagcaatctaaaactaacaaatctgccagttaaagcagtaaccggatcaaaaaatcaattggatttatcttttaaatttcgccaagatatttacgataaaaataagggaccggaaataattcaaggaaaatacattgttggtgatatttttataacatcaaatagttattatgatccaacagaaagagcagtttttttagggaattcgcaaatttctcagcaaggttttgtaattccctataatttttcagggacgctaaatcctaaagtagagatgagcatcaataatgactatcggaaaataaacgtcgctttttcacaagaaataccgaaaaaattaattgattatcaaaaaaagaatggaatttacaagctaaaaattacaaattaccctaccccttttattaaaacagatcgaattagaatctcaaatcaagattttaaatatgttgccactaattttttaacaattcaacaattaaaagatctttcttttactaactttaaagaagacgatgatgagaaagaattagaggaataaaattaagggcgcaattaaagtaggggcagctcttatctcggttgggataattgctggagctggttttggaggttggtatttatataatcacaagttgcaaaaatcaattccatctttaaaaaaacagcttgattttgatgtaaaatctgatactgattataaagatagtgatgtttttccaaatatttatgccaacgatttttatgatacaattaaggttaaaaacggggaagtttatattgatgagtgattagtggagaatgtaattaaggagattgtttcaaaaattaaagttgctttcggaacggtcaattttcgataccaaattgatgagaaaaaagaaacaatatatattgaaattttatgaaaatataaaaaacatatgttaaatcgtaactataaaattagtttatatcaggatatttaatattagttattttcgaaaaattaagtataattatttttgattttatgttaaaaataattgctcatattgatattgataacttttttgtttcatcagaactaaagttaaacccaaaattaaaaggacagccaattgtaatttcccgaagcgaggattttgcaatggctgtttctgtctctaaagaggttaagtcaaaaggtttcaaaatatcagataaaattaatgaaattaaaaaaaagatacctaatttattagtaattcatccaaatataaattattataaattcttatctgatcaattttttaattttataagtaaaaatttttcaaaaaaaattgaggtttattcaattgatgaatgttttattgatctaacagaatattcccgaaaatttaagtcaattacagatatgctctattttattaaaaataaactagtaaaaaattttagattaccaatctcaatcggactatcctataataaattattagcaaaaatggcaacaaatttagccaaaaattcagaagcaggcattatgcaggtttcaacaaaaaaagatgttaaagcttttatttatcctcaaaaaataggcaatctttttggaattggcattcaaaatactgaaaaattaaaaaaattcggaattatcactattcaagattttatccaaaaaggtgttaataatgagaaaataattgaaattttaggagttaatcgttattatttttttcatgcattaactaaaataggtgatgataatgtttgtgataaacttgaaaaattcaagagtgtttcgcattttcgcactttatcaggagatattttattaactaaaaagcaaattttagacggtgtttccgaatttttactagaattagtagaaaaactaaaaaaattcaacaaagcagcaaatcgtgttgaatttttttttaaattaaaaaataaagaaaaagatcattttttttctgatataagtttcccctcaaatgattatgattttctttatcagaatttgttagcacttgttgaaaaaattgaaaatttttctttaattcacggctttggtatcaccctatcaaaaatttcagattatgataaaagtatgttaaatactaatccaaaagtaaaaaatattgttgcaaaagttaataaaaaaatcgggctgaagaaattatttgtcctaaaataccttaaaaattaaaaaaatgaaaaaacttttatatttttatttaaaaatattttttctaatatcagtagttttagcttttgttgcagcttggaattacacattaatatttggatggcttttttctggcattagcgttttagcatcttttttttcaaaacacttttttttaaaaagaattgtaataaaaattaaaactgaaaaaactacgttttttaaaggattttttgcttatttgggattaattttatttcagggattaatattgatttccatttattttattaataaaaaattccaaaaaaccaatgctaatagcatttttggaattttttcttatcctgttaatattttttcttttatttttggctatacaattttcccggtttgtgctataataataaattctataaatataaaagttagtcaaaaacaaaaaaaggagaaataatggatttttttcgcgactgaaatcaaccgcaattatttaccctttttattctagtatttcttgtaataattttatcaattattattttttttcatataaaaaaagcaaaaattgatgaatccccatcagctgttgttttgtttgctgaatcttacctaatttttattgatgatttagttgaaactgctggagaaggttatattaacaaagtaaaaccatacattttttcactttttaccttttttttactaggaaatttattatcacttgttggcttagagccaatttcaacatcaatttcggttactttaagtttggcctttattagttggtttggaatttttgtagttggcgctatttattcaaggtgaaaatatttgtctgaatttgcaaaaaatcctttaaaaataatagggattccagcgccgttaatttcattatcgtttcgtatgtatggaaatttaatttctggatcagttttattattaataatttattcaggcgtccagtgaatttatcaaaaaataccattagggacttttggtaattttaatttgccgattgtcttgatttttccaccttttcttatttattttgacattgttggctcgttaattcaatcttttatttttgtaattttaacaacttcatattgaggtatggaggtaaatcaggatgaagcaagattaaaaattaataaaaaacaactaaatttacagaaaatttagacttaaataacttaaaaaaggaaaaaaatgaattctattgttaatttttcgcaacaacttattcaaaattttcaggaagtaagtcaaagaactgcggcagattcatcaaatttaaaagcatttgcatatttaggcgcaggactggcgatgattggagtaattggggttggtgctggccaaggatatgcggccgggaaagcctgtgatgcaattgcccgtaatcccgaagcacaaaaacaagtatttcgtgtgttggttatagggacagcgatttcagagacatcttcaatttatgcgcttcttgttgcactaattttaatttttgttggataattttaagcaaaaattaaaatttttattctttgataggtttaaaaaaagttaaaatggtaaatctgaatcaatcattgggtgacttatttaaagggattatccctaatgtttatgttttgggtgctacaatagttagttttttgattttgtttttatttattacttattttgtctatcgtccgttaaagaaatacataaaaaaacgtaaggattttttacaaaaccatatagatctaacaattaaatcaaatgtagaagctgaaaaacttgaaaaaaaaagtcaacaaaaactgctagaaactaaagagttttgcattgagcttaaagaaaaatcacaaattgaagctaatgaatttcttgaagatgccaagaaaactgcaatcgataatgcgcgtcaactaattaatgaaggccaaaaagttctacttgaatacgagaatgaaattaagtctaaatattatatgaatgttataaatgttgcagttgaaatctgtcaaaaataccttgaaaaacaagataaaaataataaaattctccagcaaagtctgattgctgacttggaaaaggagctaaaaaaacgcgaaaattcctccaaaaaaaaggataattttggtaaataatgtatttgtataaaaaaaattattatggttatgctgagagtcttttggatatttccatttctgaaaataatgttgaaaaatatataaatgattgtttttttattcttagtataattcagaataatcaggttttaatcttgttgtttaagtctcattttattggaaaacaggaaaaatttaacataatagataaaattttttcagcaaaaattgaaaaaattttagttaattttcttaaagttattgctaaaaataacctttttttatattataagcaaattttgctaaaatatattaagctggcaaattctcatttaagtcaaacttggggtgaaattgaaactgcatttccgatttcttcagtaatgacttcaagtttcgagtctattctttcaaaaaaactaggaaaaaaagttcatctaagacataaaattaattcaaaattaatttctgggattagaataattgttgataatcaaatttttgaaaattcacttttttccgaacttaaactgctaaaacaaaatctaaaaaaacacctaatcaccaaaaatgatctataaatttaaaggttttttattatgaataaagatataaatatagccgcaataatcaaaaatgaaatagaaaattttgaagggaaaattcaaaatcacgacattggaaaggtcattattgttggtgatggtgttgcgcttgtatcgggaattgaaaaagtaaaatttggtgaacttgttgaatttgaaaataatgttttaggaatcgcgctaaatttagaacaagatttaattggcgttgttattatggctagtgaaaattcagtttttcaagggtcgatagttagaagaacaaaatcggtaatttcaattacagttggtgatcaacttttaggacgagttgtaaatgctctaggaattccaattgatggaaaagcagaacttgataatagtctgaaaagtgcgatttttacaaatgcgccgtcaattatggacagaaaaagtgtggatcgcgggctaaaaacaggaattttagcaattgattcactagttccaatcggaaaaggtcagcgtgaattaataattggtgatcgccaaactggaaaaacaacaatcgcaattgatgcaattttaaaccaaaaaggaaaagatgtttattgtgtttatgtagcaattggacaaaaaaactcaagtgtcgcacaaattgtttcgcttttagaaaaaaaaggtgcccttgaatatacaacagtaattttggctggagcaagcgaactctcacctctccaataccttgcgccatattctggggcagcgatcgccgaatactgaatgaataagaaaaaagatgtgctaataatttatgatgatttatcaaagcatgcaattgcctatcgaactttgtcactacttttgagaaggccgcccggaagagaagcatttcctggggatattttttatcagcattcttacctccttgaaaggtctgcgcaactttctaatgacaaaggtggtggttcgattacagctttgcccataattgaaacccaggccggggatatttctgcatatatcccaacaaatgtaatttctattaccgatgggcaaatttttttacgagatagtttgtttaattctggccaaaaaccagcaattgatattggcctttcagtctcacgggttggttctgctgcccaaactaatttgatgaaatgagcatcttcatccctaaaattaaacttagcccagtataatgaacttaaagcttttgcccagtttggttctgatttagggcctagttcacagttaattttagatcgtgggaataaaatttatgaaattttaaaacaagaaaaccaatatccactaactgaaaggcagcaaattatgttgctaattttgattcgcgaaaatctaatcgatagtttagaacaaaaatcaataccattatttaagtcagcgtttttaaaatattgtgattctgagcccaaatttagagacaaaattgaaaaaatggattataatcgtgttctagaacccaataatcttgctggaattcttaaagatatcaccgattttattgaaaaattcaatttagggaatgtattttagttaatttttctgtaaaaatgagtaaaaaatgcccaaattaaaccgacttagagcccgatttgtccagattcaaaacattgaaaaaatgacaaatgtaatggaaatgattgcgaatgcaaaaattccaaaaataaaaaacaagtttaaaattgttcaagaatattttgaaaatttagattatatttttcaaaatattcttgcaaatttatctaagaaggttgaggaattaactaatgctgattccaaaaaaaatctttatattatttttggatcaaatttaggtttttgtggtgcccttaataatttaatcttaaaaaatgttgtcccacaacttcagaaaaatgatgaaattatcgtctttggtgaaaaaatttataattttttgtcaataaattactctaatttaattattaaattttttctaaatattgaagaaactaattttagtgaaccaattttagaaatctcaaactttgtaaatcaatcgatttttgagagaaaatataaaaaaatttttatttgttataacaaatttatcagtattatacattcaagcccagagatgcaaaatttatttgatttcaaaaaaaatactataaaatacggtggttacgggattgagtttgaaccaaatgctactgaggtttttaaaaaattaatgcccttttatataaaatccatccttgaaaaactttttatcgaatcaaaattagttgagacttcaactagacgaacatcaatggaaagtgcaactgaaaatgccagtgaaattttgcataagttagaaacagaaataaattcaagtcgtcaagcaatgattacacaagaaattattgagattattagtggtaaaatgtagaaaaagtaggtaaatttatggaaaaacaaaaaaatgttggtcatattgtacaaatttttggccctgtcattgatgttcagttcccaaacgaacatatgccggcgattctttcagctcttgaggttaaaattaacgatgagagtataatttttgaggtcgcacagcatttaggtgaaggaattgttagggcaatcgcaatgtcaatgacttataatttatcaaaaggacttgaggtttatgatactggttcacaaatttcagttcctgttggaaaacaagtactttctcgaatgtttaatgttttaggtcaaccaatcgatggcggaaaaccacttgattcatttataaaaaatcctattcatgcaaaagcgccgacatatttagagcaaaaagcaactagcgaaattttagttactggcataaaagtaattgatcttttaataccatttataaaaggcgggaaaatcggactttttggcggagcaggtgttggcaaaactgttttagttcaagaattaattaataatatcgcttcaaaacatggaggtctttcggtttttgctggagtcggcgaaagatcgcgcgaaggaaatgatctttattttgaaatgaaaaaggccggtgttctagataaaacggcgcttgtttttggacaaatgaatgaacctcctggagcaagaatgcgagttgcgctctcagcactaacgatggcagagtattttcgtgactatgaaaatcaggatgttctactttttattgataatatctttcggtttactcaagcaggctcagaagtttcaactttattaggaagaattccttcaacagtaggataccaaccaacattatccactgaaatgggtcagttacaagagcgaattacatcaacaattcgcggttcaataacctcggttcaagcggtttatgtcccagctgatgatatcactgatcccgcaccagcaacaactttttctcatcttgatgcaaaaacagttctagatcgaggcattgctgctttagggatttatccagcagtagacccactggcttcatcatcgcgggcacttgaaccaaatattgtcggtaaaaaacattatctagttgccaaaaaagttgttcagattttgcaaagatttaaggaattacaagatattattgcgattttaggcgtcgatgaactaagtgaatctgataaacaagtcgttgcccgtgcgcgaagaattcgaaattttttatcacaaccattcttcgtagcgcagaaattttccggaattcaagggcaatttataaaaattcaagatacggttaataattttgatgaacttttatcaggaaaatatgataatatccctgaagaagcatttttatatgtagggacaattgatcaagcacttgaaaaagcaaaaaaaatgggttgaagtgaaaaaaattagtcttaaaatccttactccaaaaggagtttttttagaatcaagtccttattcagtggcagtgaaaacaaaactaggttaccgaattgcccagtatggaattacaccttttgttggtgtgatttcctcctcaaatttgcatattttaaatgataatgaaaaaattgaaattccaattaaaagcggaattgtttatgctaacaaatatgaggttttgatttttagcgaggatcaattatcatctacctaatattaatttttttatggaaaatttcataaaaaaaggaaaaacagcttgtttttcccaattttttccttttttctgccaaaaagtgaaaaaaaacttaatatgttatatatgaaccacaaaaaccgcggaatgtttctcgaaaaaattattaacaacacaattgaattttactgtgaaaacggtattggtattttccataaaaaaaatttagatattagttttaaggcggttagtaaagatttagcagtcaatgatgcttttatttttaagaaatcaacagttgattattatggaatttataaaggaatttttgttgcttttgaggcaaaaagtacaaacgaaaatgttctaaatttaaagcaaatacctgaacatcaactaagttatcttcaaaaaattcgagaacattttggttgtgctttttttataatttttttcaaacaactagaaaaattttatattgtaagtattgacaaaattaatttatcctgaaaatctattcctgttgcatttttacaaaaagaaggttttgaaatcccgctaacatatccagggataatcgattttataggttatattgatcagatgatttaattttttagtttaatttgtaaatttaaagcagaattacaggtagtaattgtatcagaaaaagattaaattgtttttaatttttaatttttaattttatgatataatttaattcttaagctcagaataaataaaaatatcattaaaatggattcagttgggtgtgcttttttaagttctaactgttcgaaattttaagtagaaataacaaactaaaggaaaaatatggaaaaactagtaacacaacaagtccaaaatgttgatccaaagcaatccgaaatattaaatattagcgagattccagcggaaaatcctactgaaactcctattatttcaaaacaaaaattactcgaagctggggtttattttggtcacaaagcatcacaatgacacccaaagatggcgcaatttttgttaaaaaaaaagagaaatgaaacccacattattgacgttttaaaaacacaaaaaatgttggaaattgcctataaattagttgaaaagtttgctcaaaaaggagcaaaatttatttttgttggaacaaaaaaacaggcaaaaaaagtcatagaagaacaagctgtccgaacaaattctatttatgtttcaggcagatgattaggtggaactttaacaaataatcgaacaattttatctaggcttaaaacaatggaaaatcttgaaaagcaagcagcagaaaattttcaaggttatacaaaaaaggaaaaacttgcaaaacaaaaacaattagccaagttacaaaaaaaccttaacggaattaaagggcttaaggatgttcccctattttctctaattatgttagttgccgaccccttaaaggatgcaatcgcggttaaagaagctcgtaagaaagggataaaaattattggcataacagattcaaatgttgatccttcgttggttgattttgggattccagcaaatgatgattcgactaaatcaattacattaatatttacagttctagctgatgcaattgcttcagcaaaaggaggtaaaaaactttttgcatatcagtcagacgaaaatataattcttcctgaggatccagaaaaagaattaaaacaaactcgttaccgcaataattcatttgaaaaatttgctcgccaaaaaaatactttaaaagagagtcaagttttaaaaccaaacacagaaattcaagcctaaaaaataaaaataaaaatacgagaggttaagatgtcacaaattgataaaatggcaaaaatcaaaaaattaagggaaattagtgatgctccctttgttgattgtaaaaaagcattagaaaattccgattatgatattgatttagcaattaattgacttaataaaagcggaaaatcaaaagctttgaaaaaatcagatcgaattgccgctgaagggttggttttagcaaaaaaagatcctaattccgttttagtttttgagctaaattcggaaactgattttgttgcgaaaaatcaaaattttataaatttgcaacaaaagattggtgagttactccttgcaaatgattttacaaatttagaagacgccttacttattcaggatgaggcaggtaggccaatttcagaattattgattttagcaacagcaacaataggcgaaaaaattaccttgcgtcgcgtttttaaaacaaaatattctttagaacaaagtgttgaagtttatacccattcaaatggtcaaattgcagtaattacgattttaaaaggcggaaatttagaaatagcaaaaaatatttccatgcatgtagcggcattaaatccccaatatattttaaaaatcgaggttccaaacgagaaattgcaggaaattcaattagaagttgagaaaaaggcttttgctgaagttaaaaattttgagaaaaaaccagaaaatgttaaggccggcattttaaaaggaatgatagacaagcaactttcagaatttgttttagaacttcagcctttagcgactgacagtgctattacagtcgaaaaatatttagctcaaaattcagcaacattagaaaaagtagttcgttttgaggtaggcgaggggatccaaaagcagaatgttgatttttccgctgaggttaatcagcaaattcaagaatttcagaaaaaatagaaaaattatcaaactaaaaatctgaagaggggtataaaatttttcctatttttaaaggaaaagttttgtattttttataaacaaatgctagaatttttaactaatcgaattcagtcatccttaaaaaaattacaaaaatccataacaattaatgaaagtgatttagtcgaaataacacgtgaaatccggcttgccttacttgaagctgatgttaatttgttggtggttaaagattttatatctaaagttaaagcccaagtcttaaagcagggtttgacttcaaaattaaacccacagcaagaatttctaaaaattttacatcaaaatttactagaaattcttggaattaattcaaaatcaattaattttaacaaaactcttactataataatgttagttggccttcaaggttcggggaaaacaacaaccgctgcaaaattagcagtttttgcaaggcaaaaaaaattagcaaaaaaaattttactagttgcttgtgatacttatagaccagctgcaatcgatcaattaaaacagttaggaaaacaggttttaattgaggtgttttatgttgagaaatcaccagttcaaattgcaaaagaggccctaatttatagtaaaaacaatgattttgatcttgtaattttcgatacggctggccggctttcaatcaacgaagaattaatgaatgagctttcagaaattaaagaaaatattaaacctgatcaaattttatttattcttgatgcactttcaggtcaagacattatcaatgttgctcaaattttcaaccagaaaattaacctcacaggagcaattattacaaaattagactcaaatgcgcgcgcaggtgccgcgctttcaataacgcatttacttaaaattccggttttgctcgtcgggacaggtgaaaaaatttctgctcttgaactttttcatccaaataggatggccgatcgaattttaggaatgggggatgtaaggtcacttttagagcaagcagaggaaaatattgacaaaaaaacagtaaaaaaattatctcatcgaatgttttctggccagtttgatttaaatgatcttttaaatagtctagcccagattcagaaaatcggaaaattttcaaaaattattaaaatgataccaggtttatcaggaaaaattgatcaaagtcaaatagatgaagttgagaaaaagatgaaggtctataaaattttgatttcttcaatgacaattgaggaaagaaaaaaaccaaaaattttaaaaaatccctcgcgtcgaagtcgaattttgcgtggttctggaaggtcaagtgctgaatttaaccgtttaattaatgaatttgaatcaatgtcgaaaaaaatgtcagaaatttccacaaaaaatcttaatcttgactcttttattaaataaaaactaataattgttaaggattgaataatggccaaaattgaaaattacaatttttttattaaccaactacgggagctagggtttgtttttccaagttcacaaatttatggtggtctggcaaattcgtatgattatggtcatcttggtgtgcttttaagaaaaaatattgagaatttttgagctgatttttttgttaattcaaatcctaatgcattttttattgatagtaaaattttattaaacccgaaagtttgacaggcgtctggacaccttgataattttgttgatttattagttgaaaataaaattaataaaaaaagatatcgtgttgatcatctttttgaagaattttttcctgaggttgaatttgaaaaattatctcaggatgaaattcaggggtatttatctcaaattcaacttttggaaaatgcaaaagttgaatgagctagcccaaaaaaatttaatttactttttccgacctatcaaggcataatcgaagatgaaaaaacacttttatatttaagaccggagacagctcagggtatttttataaattttaaaaatcttctgcggacaacaaaaaatagtttgcccttgataattgctcaagtaggaaaatctttccgaaatgaaatttccccgggaaatttcatttttcgtacacgtgaatttgtacaactagaattagaaatattcttaaaacccgatcaatcagagaatttttttcaaaatgagattgaaaaaattaaaaactttttaaaaaaacttggttttgcgaaaaattcaatcagattaaactatcacaaaaaagaaaaattagctcattatgccaaggcaacagctgactttgaatacaattttaattttgggtggggtgaattgatcggaattagtaatcgtggtgattatgacctcaaaaaccatagtgagaaaagtggtgagaagcttgaatttgttgattcagctacaggaaaaaaatttttaccccacattatcgaaccttcgatgggccttgatcgtttaatgttggcggttttagaagaatgtttttgttttgacagtgtaaaaaatcgctattttttaaagctaccatttattctaagtccttataaggttgcagttttgccgcttttgaaaaaatttaattttttagcagaaaaaatttgaaatgaattaattagccaaaaaatatcagcaacactagtaacttccggttcaatcgggaaaagatactatcatcaagatgtgattggaacgtatttttgtattacaattgaccaaaaatcggttgaaaatagcattgtaacactaagattccgggatacaaccgagcaaaaaacactaaaaattgacgaaataactaaatttatcaaggaaaattttgttaatgaatagacaagaaattataacacatataataaaaaataccgatatttacgacctaatttcaaaaaatataaatttaaaaccaaaaggtcgagattcttttgtcggtctttgcccatttcatgaagatacaaatccgtcgttgtcagtttccttaaaaaaacaaatttttaaatgtttttcgtgccaaaaatccggtaatattataaattttgtaatgttgttacaaaatttaaattttttagaagccctgcaatttcttgataaggaatataatttaaaacttaagctaaattataccacaaaacttgaaaaaaattattcaaaagatgagcttcaagcattacgagcctttgaaaacgcggtttctatttatttagttgaacttatcaagattttctctttaggccagcagaatttgattatcgaaaatcctatttttttccagttatttaacttccttaaatcacgcgggattacaagggaaattatcgaaaaatttaaaatcggatttgtgccgacaaactcaattttaaaaaaatttttaattgattcaaaattttttgatggcgaggttttaatgaattattcacttctaactgttaatggaaatgatttttttcaaaaaagacttgtttttccgattgaaaattttgaaggaaaagtggttggattctctggtcgctgtttagatgataaaatatgtcaaccaaaatatttgaattcatcctcgaatagtttgttttcaaagactgaaattctttataattatgcaaacgcaataaagcaaaacccaaaagaaatcattattacagaaggattttttgatgtaattgctttttataaggcgggaattcaaaatgcagttgcactgatgggaacaactttgacaaaaaaacactgtgaaatgcttaataattttacagttttactcgcgctcgatagtgataaggctggtgtggaagctagtctaaaatcaggacttattctgggacaaaaccgtataaatacttatattttaacaggttttgaaggcaaagatccagatgaatatttcaatacttttggttcagaagcacttgttaataaactaagtaatcgaataaatagctttgatttcgcttatgatttttataagaattctataaaaaataattcaagtgaagagataaaaattttcattgaaaaatttagtccctttttagaaatattatatcaccaaaatctgcaattagcgcaaatttttttcaaaaaaattaaggaagattttggtatttcccaggatagttttaaatttagaccttcagttcaacattataatgaattagaaaataccttaaaagaaaatgaggaccaaattaaaagtattcacataaaaaaaacaactaatttatggctagcaaaaccgatttcaaccgaaattcaagaacttaaaattttaagtcaagttttagatgatattttataccatgacggtgaaaaatataatcgttttaaaggaaagcaatttaaatttctaaatccattaaataataaattaatggaagaaattaacatttttgggtataaaaatccaaaaatgcgggaaaagataaaaacaaaattaaaggaagtaaatgctgaattagaaaatttaatatttaaagatcgcatagaaaaactcataaacgaggatttaaattgaaaaaaagagaaaaatgccgatgatttagacaatttaatggaattaatacaaaaaacaagaggcagaaaagatgccgataatattcgtaaacttcaacttgataaagaaatgaataatgagtttgtgggcaagttctttaaaaaaattagaggtctataatcagaaaaaggtgggtgtttatgctaaaaaaacagttaaaattcccaaaacaagagagttttattgatttttcgttgctagaaaaaacgcagaaaacaaaaaaaattattgataaaaaagtttcaagtattagtgtagaagagataaaaatggaaaattcattaaaaaaagtaaatatagaagaaggaaaaaaaacagatttaacaagagaagatggaattaaaaagccaaaaaatacaaaaaaagcaaatcttcgtgagcgaagaaaaaattcatacgagcaaatcgaaaattttttcaacattatcaaaacatcaaaacaccaatcagattttttaaagaatttagaacaatttcgagcaaaaactttattgcaactatctcaaaatattaattcaactagtttggctcagaaatcaaaaaaagaagaaaaatctaaacaaaaaacagaaaaacagctaaattccaccctggtatcccccaaaaaacccgtaaaaaaagctaaaacaaattcagttaaggaaaaactaactaaaattatcccagtcaaaaaacctgataatatagatttacctaaaaaaataacagaaaataaagaacttttcccccaaaaagaggattttattccaatttctaatattaatcaaaatagttctgaatataattttattatcgagaaattagaacaagaattagaacaaaaacaccaaaagataggaaaaaatagttctaatttagataatttttctatttttttaagtcacgatgaaatttataaatatattgaaaagtgaaatcttgcaattgaagaagaaaaacttgatgatttttttcaaactttaatacaaagaaaaataattgctgatgaagtcgataaggaggatcttgaaaatgtttcaagttttgattttgccgagcaaattaataataaaaaatctgttagagataaaaaaaataaaaaatatagtcaagattttgatcagtcactaataaacttagatgatcaaaatttcgatattaatcataacgaggaagatgataattctgacctaaatctaggacaatcagtcgatgattccttaaaaattcaggaaattgacgacctggattatataacagaaaatagtccaaatcaataccacaaaccaaaagtttatagtgatgaagtttaccttaacaaactgaccgatacaagtgatatgataaaatggtatatgcgttggattggaaaatatggaaaacttttaacggctgaagaagaaagagaacttgcaaaaaaaatgaaaatcaaaggccggattggaaaaaaagcgcgtgataccttaataaaacggaatttacgtttggtggttaacagtgcaaaacgctataaaaaccgcggtcttggatttatcgatctaatctcagagggaaacctcggtattattaaagcagttgcaaaatatgactatacccgtggatttaaattctcaacttatgcaacctgatgaatccgccaagcgattacaagggcggttgccgaccaagcccggctcattcgaattccggttcacatggtcgagacaatcaataaaattaataaggtagaaagggaattacaacaagaaaaaggacttaatccaacagccgaagaaatttcagaacgtttagatggcgaatttagccctgataaaatacggtatattaaaaaaatcaatatcgatccaatttcactagataaagcaattgggaaagaggaagatagttcattttctgattttatcaaggatgagaatatgatttccccagtagattatgcaattcgtgaggaaaaagcgaaagttttgcttgaaatgatcgattcaacacttgattatgatgaaagagattttatcaaaagacgttatggggtcggaacaaacgatgaaggaattccttatcaggcccatagttttgaagagcttgcggcgatgcgtcgagtaacaaaagagagggttaggcaaattgaggcaaaaattctaaaaaaattaagaaccccacatcgccgcctatcattaagggattttaattaaaaagtaatgaaaacaaaggaagttggcgattttctccttgaaaaatttccactagaaaattgtcaaaattgggataagtgtggctgacaatttctttttgatactaaatttttaggcgcaactatttgtcttgatctgacaaatgatgtcctagattttgcactaaaaaacagttctaacttgataataactcatcacccattttttttctatcaaacaaaaaaagaggaatatgcctattcaccttataaaaaaaaacttactcttttacttaaaaaaaaattaattagcgtgatttcactgcatactaattttgattcaaaagaaaatcaaactgctttttcaataataaagcagtgtggattcgattttgaaaaaatcgaaaaaattgatgaattcaatattttgtttcaaactagtgcggattttaatgaaattttaaaaaaaatttcattaaatacaaatttaactactttccgcagcaatgttgaaaaaaatttttttccaaaaaaagtagcaattcttcctggttcaggcggaattttggcctgccttcaagcaaaaaaacaaaaagccgatttaattatcacctcagatctaaaatgatccgatcagataacattataccataaaaaaataaaagtcctagaaattccccatttaattgagcaggcttttgtctttgaaattgagcgaattttaaaggaaaaatatagcaaaattccaacctttacagttaaattagctgaaattttaaaagaaatgagattattatgataaaaataggctcccatgtaagattcagaaaacctgattatctttttggtgcaattcaagaatcactagaaaataaagcaaacactgcaatgatttttctaggacctccacagtcaactttccgagtcaagcccgagaattataaactccaagattatcaaaaacacttttttaaacaaattccgcctgaagatattattgttcatgccccttatattataaatccggctagtcctataaaagcacaattttctaatgattttttagtaaaggagatcgaaaaaataaactatatcggggcaaaatttttggttctacaccctggatttttcacaagttttactaaagaagtggcaaaaaaacagttaatttcatcactaaaatcaattttagaaaaaactaaaaatgtaattttattacttgagacaatgtctggaaaaggtagtgaaatgtgcgctaattttgaagaaattgttgaaatagttgaagcagttgaatcaccaagaatcggaatctgtcttgatacatgccatgtctgggatgctggatatgatcttaaaaattttcctgaattttgtaaagaaataagaagaacaaggctaattaattatttgaaagtgatccatttaaatgattctttaagcccactaggttcaaaaaaggatcgacatgctaatattggcaaaggttttattgggcttgaaagcttacgcaaaattatttttgacccactttttgctaatattcctaaaattttagagacaccttatgttgataataagcctatttatgatcaggaaattgcgcttttattaaaaaaagtttaaaatttaaaggtttttatgtcatatatagaaaaacaagaatttctcactgaattaaaaacaagaaatattctaaaggatatcagcagtcctgaaaaattttttaatctaaaacctgaccaaggaatttatatcggatttgatccaacagctacttctctgcatttaggaaactatatttcaatcagtctacttaaaagattacaaaaaatagggataaaagtacttgcagttattggtggggctactggaatgattggggatccatcttttagttcaaaagagcgaaaactacttgattttaagacacttaatgccaataaagagaaaattaaaaaacagttagagtcctttggtttgccagtttttgataattttgagatatataaaaatatgaatattcttgattttttgcgtgatgtcgggaaaaatatcaatatttcttatcttttagccaaagaatcggtggcttcgcggatcgaagttggtctttcttttacagaattttcctaccagttgattcaaggctgagattttaaatttttagcagaaaattatcaaataatcggtcaagctggtggttctgatcaatgagggaatatggttactggtcttgattttatcaaaaaatcaaatttagtccaaaaagatgaagcttttgtgtttacaactaatttattaaccgacgaaaacggccaaaaatttggcaaaagtttaggaaaaccaatctggcttgatccagaaatgtattcgccatttcatttgtaccaatttttattaaatcaaaacgatgagcaagccgaaaaaattatgttgtggttatcttttttagatctaaaagtaataaatgagctaattttcaagcataaaaatgataaaaaacaacgtattttacagtataatttagcacaagaggttgtttttaatatccatggagacaaaggcctaaagatagctaaaaaaattacaaaaattttatttgaaaaactagattatacagaaataacatttaaagataagttagaactaaaaaaaattatcccgtattttaaagtatcttttttcaatgccaatcaaataatcgaccttggaatatttaaatcaaagcgtgaattaaatgaatttatttctcataaagctcttgaaattaatggatctaaaatctcaaatattggtgatataactgaagaactaaaagataaaagcaatttatttttgcttagaaaaggcaaaaaatacttttttatcatagaacttatttagtgtttttttctaaaaaaacatttataatattcatacatattttgaaaaaagtatttttttttaaggaaattttatggaagttgatagtgtttatgaaaatcttaagaattgacaaaataaattattagatatttcaaagaaaaaccgcctaattaattttaatttatttcagccaactaagtctgttccactaaaacttggtattttatttcctgattttaatcagtttttagacaatattattgaaaataaaacaactttatttttcagatcgcttgatcaacaaaaaaaagcatctaaaaaaaacagccataaattaagtgattttttgcctttaacacttgagcaacttcaaataaatacaaaaatttcaaaaattcctccaaaagtaattatttcggattttttacttgaacaagaacaattaataattaaaaatttatatcaaaaatcaaaaaattataaagaagaaaagtcaataaatattctttatttagggataggatttttaaaatgatacgaaaatactgaggaaaacactcctatttatagtcctatttttttatttcctgtccaaattaaccgcttgatttttcaaggaaaagaaacaatttcgctagaatttctcgataatgcctttctaagtataaattttacgcttctaaaaaaactgcaaatcttaggactagatactaaactttctaaattcagaatcgataattcgctttcgattaaggaaaattacaataattttaaaaagttattcagtgaaggtaataacttatctaactgagaaatgattgagaccatccagttaagcgcttttgactatagtaaaattgaaatttatactgatttggttgaaaaccaagaaaaaattattaaaaataatttttatacagaaataaatggaaatttttttggttcagattctttaattaaaactactgacgaaaccaaaaaaatcaaaaccgctgatgaattcaataacatcaacccacgcgattattttcatattttagaagcagattcaactcaagaagcagcaattcaggcggcgataaaaggggaaaattttattttagatggacctccaggaaccggaaagtcacagacaattactaatataatcaacgaatttttggcaagagggaaaacagttttatttgttgctgaaaaactagcggcactaaatgttgtttattcaaaccttaaaaaaattggattatcagattcggtaattgcgattcataatgaaaatataaataaaaaagaaataatcaacgagcttttaaatactttagaaaaaggatcaaattcaattttaattaataaggttgaaagcaacctaatcgaaaataattactctgaattacagcgaaaattgaatgattatggtgataaattaacaaaaattcgtccacagttatcaaaaagtttatatcaattaatagctgaatatcagaatcttgccgatttttctagttttgatttttatttatctgaggaaaaaattaggaaaattaactatgaaactctacagaaaattcaatgagctcttaataatttgtttcaaaaattaaaaaatattaattttaatttaaaaaaacatccttgatatggttttaaatcggcacaagttgatgaatttgaaaaagaaaaatttagaacttggttattagaattaattaaattaagcaagctaatttttgaaaatattaaagaatttaagttttttttaatgcattctgatcaacatcttagcaatattataaatttatcagaacttctagaatccttatataaattaacaaaaatcgatttagtaggcttgcaagaaattgaagatttatcatttgagatagaaaaatatagtcaaattaaggaaactaaggcagaaattattagccttgaagataatctaaaagtttattttaaaagaattccgctaaatattccgcttttggagtttaaagaggttattgaaactcaccaaaattccaggataaaatttttggactttaagtataaaaaaattaaaaaaaccttatctacttatcttaaagatggttatgagcctgaaatttttcttaaaactcactcattaattcatttattaattcaaaaaaaattattgttatcaaaattagttgagagtctcaaatttaaattaagtctgaattcagaagaagaaattgaaaataatctttgacagctgaaattttatgtaaaattaaaatttttaaataattcaacaaaaattaaggttcaagacaaagaatttgttgactttttctttgattcaaaatacacaaaagaacttttaacagaaaaattattttccccagttattaaatttatgcagatatgaaaggaatttacttcatattttgattctaaacagtttgattttttgtttcttgaaaagaaaaaattcgaggaaaacttacatcaaaagtttgtaaaaatcgaccaaatttatgaaatttcgcggattaatactgatattaatgcgctaattcaattagaaattgatgattttgtaaaaaaagtaatagaaaacaacattcagcaagatttttataaaatttttactaaaaaattttataaattattaattaatcaaatagttcatttggaatttgaggcttttgattgacaaactttgcatttaaaccaaatgcagtttgaacaagcccagaaaaatttagaccaattaacccggaaaaaagttgattcaatccttctagaaaaaattccgcaaattgactctttttccgataaaaattcagaaattagaattttaaaacaagaagcaaataaatctcgtcgcttaatgccttttcatgaactttttgtccgaatacctaatctgttaaaaaaattaaaaccttgccttatgatgtcgccacttttggttagttcatattttaaaaatagtgatattgtgtttgatcttgtaatttttgatgaagcctcgcaactaaaaccagaaagtgcaatcggcgcaattatccgcggaaaacagtatataattgcgggtgataaagagcaaatgccccctacaagtttttttgatagtctttctgaagatggagaaaataacgaagatctagcagaatttaatgtttctgattatctttcaattcttgatgtaagccaaacttttttaaaatcttatagattaaaatggcattatcggtcaaaatttgaagagctaattcaaccttcaaacattgaaatttataataatgatttaatgacttttccggcaatcgaaaggccacaagaatttcaaggaattaaattttttaaagttgaaaaggcagtttataaaaatcgtagaaatgaaaaggaagccgaaaaagtacttgaagtccttgcagaaatttttcaaaaatatcaaaataagtttacaattggagtcgttacaacaaatcttgaacaggaaaaattaattgctgggaaaattgataggtttaaggcagaaaatccgcggtattttcaaggtatatcagaaggtatttttgttaaaaatattgaatcagttcaaggtgatgaacgagatattatcattttttcactgaattttgggcctaatccagagggaaaaatttctgctaatttcggagcaatcaatcaaaaaaatggttatcgccgtttgaatgtcgcttttactcgcgctaaatattcaacagttgttgtttcttcaattgaaccagaacaaatcgatctaacaaaaacaaaagccaggggcgctgtttttctaaggaaatatttagaaattgccaaatatggcgttcaatttagtactcaaactacaaaaaccacatcaaatgaagtaacttttgaatctattgtttataatgaactaaaaaaattaggttataaattattaaaaaatgtgggttattctaattataaaattgatttagttattttaaatcctgaaaatgaagatcagtttttgctaggcattgaatgcgatggttcaatttttgcaaaactaaaaaacgcgagggatcgtgatattttaaggaaaaaagttcttgaatcgcgtggttggaaaatttttagaatttggtcaattgattgatttcaaaatcccaaattacaaataaaaaaaattaaagaacaattaaaactaataggaactaaaaaagctgaaaaaagccaggatgtgttagccaaacaaaacaaaactaatgaaaatttgattttaatagctgaaaaaccaaaaaacgatttcagatccgcatttcaaataagatttaaattggattttcaaaatttaattaaattatatgataaaattaaagataaatttagtttattaatctatatttttgaaaaagttcaaattttacacaaaaatgaattttataaaattgttgcctgattagatggtaagacaagaacaagtattctaactaaacaagaggcacttaaaattgctaataatctgataaaaaaaggtataattttcgaatcacaatcacattatttattaaaaaatgttgtgaattataattttttctttcaaccaaaaagaccaataaaggaaattcactatttcgagattaaagatttgattataaaaatagttcaacacacaaattcgataactaaagccgatttatataacttaattttagaagtcactcatttcacaagcctacaaaacaaaactcgcgactatcttgatagatgtcttgaaaaattaataagtgaaaaattaatttttattgatagatatagcaatttaactttatagccctaattgttttgttcatttttctattactaggttgataactttttatgctaaaaaaagttgtttttatatcatttgtggtataatttatgtaattaaaaaaggtgggtatgatgaaaaagacgctgaaattaggtctacaggtaagccttcccattatttttttctccggaattattacagccggtgttttttttcaacctcaaaaaaaagccaattttcctaaaaatttttcaaatgagataaaaaaaccattattaaatgagattaattatcttgctcttggtgattttttaagcactggatttgattgaaataacaatcttgatggtcggagtaatatggtaaatggctcaattacgggaatttcttttcctgctttttttgttaattttgcccaaattattaagtctgattccgttaagtcatttaaaaatttagccttaaatgattcaggaattttggactgattatattttttggagccaaaaaataattttcttgataaggcaagattgaataattttaaagcgcaaatttacaataagtcccgattcacagagataattaggtcggtttttggggattttagttctagttttccaaaattaattgaagagataaaaaaagcaaatttaattagtatttcacttggatttaaagattttttagatgcatttaattctcaattttttgatgatcttaagctttcaagtttaaaagaaaatagaaaaaacactgattttgtgctaaaagtagacaaaattttcacaagaattgaggcaaatttagaaagaataataaccattatcaaaaaaataaatcctaaagctcatataaatttaatagaatactatcaaattcagccaaaaatccaaaaatatttacaagatttagccgaaaattatttaatagaaattaatgataataatctttcgatttatcgattgaacaaactaatccaaaaagtagcccaaaaaacaggggttaattatataaatccttttagaggcgttaattctaaggttggtgatgaattttattttgatagtcatatgaattttcgcccgcaaattaagggaagtaagcaaattgcgcaaaatttaattttatcgttaaccctaggtaaaaaccaaataaattctctatctgaatcaaaagatcgcagaattcaccaaactaatttttctagcgatttaaatgaaaaccaacaaattaatttagctccagataaagaaattttagaaaaactatcgcttaatggttcattgctaaattttgtaaaagctgattcaaattttgaaaaggaaagcattcaggcattgcatacttttaaaaaagaggaaaaaactaatttttctgcaaaggattttctaagtaaaattactccacttcttgattcacagcaaagtccctttgtaaaattagtaaacgaaataattgatacttttggcaatgaggcaaatcctaattttgaagcatttaataatattattgacattattttcaaaagtaattttgtcacaaatcttcttcaggtcgcccaaagttatttatttaattcctcacctacaaaccagacaaattctaaaactgaacaaaaaaaacccgatttacttacttatttaaaatcgaccgttttaacagaaaaagaaattgttaagcttttaattgaggttttagcaagcccctatgttcaaaaacaccaaaatgaaactattagtttattttataatctatttttccggcaaaaaaagattatcaaactaattattatttcatttaccaaagatccagtttatcaggaaattatcagtcaagttttagattttaatactcttcaaaaatttgtaatttttattttaacggaattaattaaaaataacaaggattattcaactgttagttcatttaaagatttattgttgctgtttttgcagaattcaaataattataataaatcaatcacttttatccgaaattttgtaattgaagcattcaaacagacagattttctaaaaaatgttttaaatttattattaaataaatgaagttttagtataaatcacgacgatcaagcttctttagtatctctaatttcaagcatcagcgacatattgacaagaacaaaaacttttaaaaatttaattaatttaatatcaagggaaattatattaggacttaaactaaatagcgaaaaaaatagcagtaatttaggatcttttttagaaattttaacaaatttgcctcttaaaattcaaaatttttttaaggaaaaagataatatttttaattcatcacaagatattttacattttagtccttctgtcagacagttagatgcaataaaagcttttattgataaaattttaccttttattaccaagataaaaatcaaactaacagattttttgggcctagattcaaataattttacagaaataaatttagtttttgaagcttttgtaaaatttttatcagaaaataattttcagcaactatccaaattaatcaaagcttttcttgagagtttttttgtaattgatagtttaaaatatcggaatagtttggattttaatgggataatttttaatttaataagtaataattccgagataataaagcaaattttcttggattttgtaattaccaataaaaataatacgcaaattttaggtataatttcctcaatatttttaaaaatgattaataataacgcggtaaaacaccttcaaggccaggaaacaaacacatttgatcgtataaaaatttattatttaattgatacatttttactaaaaattaaggaattaacaaatcaatataatattaatattgcagaaattaattcaaaattagcagattcaaaaaattccttagaatttcccgagttaattaaaaaacgtgagaatttaaagacctttttaaatattaataagcttaaaaattaaattttgttaacttatttttttcaaaaagataacaaaatttaaatgctgaaatttgaattattccttagaaaataaactttttatttgttttttcttcattttttccttaacaaataaatcgacattttcttgaattaaagcaaagaaattaagaacttcttgagctaggttaatttttttaccatttaagtcaataattttttcagttttatgccttttattttttaccattccaaaaatcggaatttcaaagtgattttttcttaaaatttctataattaaattaatttgttgaattcctccatctactaaaatcaaatcaggttttagaaattttggatttttaatatatttttcaaaaccctgtctcatataatttgtatcacctttttttgttcccctataattgaaaaatctattgtaatttcgctcatatattccgtttatatagaaaataattccagttgtggggtagtttgactctaaatttgagcagtcaattgccataattttttcaacattttcaatttttaaactggttttaactagttctaaaattttctgatttttaatttttttcttaatttcttggtcaaaattatggctgataaaatcttggtgattttttgctaaagtgtttaaaatatgcttatattttaagctttttccaattttgatattaatttttgggtctaaaaattcagcatttttaggccaaaaatttttaactactaactcatcgggataaatattaattttataataattatttaaaaaattaattaaaacttctgtataattaagtataatatcaataataaaatttttattagataaaaaaacaccattgcgataaaaagcaaaactaattactaaattattctcgccaatttcactataataaagaaaatcaatattttttaggttgttaagctcaatattttgttgttcaattttagtttttttcagtgcaataagcgctttgtgatattcgttggcgagttcaaattggttatttttctttgctttttctaatttttgttcgcaaaaactaattaatttttgttcctgtagtatttttttacataaaaaaaatttttgatttaaaatttctggttctgattgtacaatttgttgtccttttttgtataagacaatattttctaatattttttttaggaccaaagcgctgcttttattaagaaaaggcccataaaaaaagatattttttgactttttgctgcgtgaaattttataaactagttcaatattcagttttttttctaattctaattttatatagggataattttggtcatctttaagtttaatattataaattggttggaatttgcttatgatttttttttctaaaattagtgcttcggtttcgttttggagaatatcatatttaatttctttagtttttctaattaaaacttcggttttataagaattagttgctccttttgcatactgattcattcgtgattttagattcttagctttcccaacatataaaagggtgtttttttcatcataaaaacggtaaactcctacctggtttggcagcatcaattttttaactaattcctgaaatttttccatataaaaattttaagttcttaaaatataaacaaatttttgataattattataattttaacaaaaaattggtataattaaatcttgaagttaaaataaattagagtgagattttttaaaatggattttgaatcatataaaaaaacttctgttcctaaaatgaaacagttgaaaaaacatggaaaaattttcttagttgttggaattatttttttgattttttttattgctttactcactttttatttagttaaacaaaatgacggcggcttgccaaatgattttatcgattcaacttgacttgcagttagtttgttgtttttggtaattagtattgcttttttggtgttttttgggatagttatttataaaattaaggctattaaaaaagttgaaagacatatcgaaactcaattaaaagaattatagctattttaaaaaaagtgaaaaaaattataataaatttttatttctagttaaaaattatgactatttttcataaattctggcactttttaactttaagtgccaaattatggtatactttcttttgtctaggaaaataagacaaaataatactcaaaattcaaaaaaattagagaaaggataccaaaaaatggcaaaagaaatcattttaggaatcgaccttggaacaacaaactcagttgttgcaattattgaaaatcaaaaacctgtcgttctcgaaaatcccaacggaaaaacaacaactccatccgttgtcgcttttaaaaacaatgaagaaattgtcggggatgcagctaaaagacaacttgaaactaacccagaagcaatcgcttcaattaaaagattaatgggaactgataaaacagttcgtgcaaatgaaagagattataaacctgaagaaatctcggcaaaaattcttgcttatttaaaagaatatgctgagaaaaagattggtcataaagtaacaaaagcagtaattacagtacctgcttattttgacaatgcccaacgtgaggcaacaaaaaatgccggaaaaatcgctggattacaagtagaaagaattataaatgaaccaacagcggccgcacttgcttttggccttgataaaactgaaaaagaaatgaaagttcttgtctatgacttaggtgggggaacttttgatgtctcagttttagaattatccggtggaaccttcgaagttttatcaactagtggtgataatcatttaggtggggatgactgggataatgaaattgtaaattgacttgttaaaaaaatcaaagaagaatatgattttgatccaaaaagtgataaaatggcgcttacaagacttaaagaagaggctgaaaaaaccaaaattaatctttcaaatcaaagtgtttctacagtttctctaccatttttaggaatgggcaaaaacgggccgattaacgttgaacttgaacttaaaagatcagaatttgaaaaaatgactgcccatttaatcgatagaactcgcaaaccaattgttgatgctctaaaacaagcaaaaattgaggcttcagatcttgatgaagttctccttgtaggtggatcaacaagaatgccagctgttcagtcaatgattgagcatactttaaataaaaagccaaatcgttcaattaatcctgatgaggtagtcgcaattggtgctgcaattcaagggggggttctagctggagagatcagtgatgttctacttttagatgttactcctttaactttaggaattgaaactttaggtggaattgcaacacctttgattccaagaaatacaacaattccggtaacaaaatcacaaattttctcaacagctgaggataatcaaaccgaagtaacaatttctgttgtccaaggtgaacgtcaacttgcagcggataataaaatgttaggtcgctttaatttatcaggaattgaagctgctccacgaggtcttccccagattgaagttagcttttcaattgatgtcaacgggattacaacggtttcagcaaaagataaaaaaaccggcaaagaacaaacaattacaattaaaaatacttcaactttatcagaagaagaaattaataagatgattcaggaagccgaagaaaatcgtgaagctgatgctcttaaaaaagacaaaatcgagacaacagttcgtgccgaagggcttattaatcaacttgagaaatcaataactgatcaaggtgaaaaaattgatccaaaacaaaaagaattacttgaaaaacaaattcaagaattaaaagatcttctaaaagaagaaaaaactgacgaattaaaattaaaattagaccaaattgaagcagctgcccaatcttttgcgcaggcaaccgcgcagcaagcaaatacatctgaatctgatccaaaagctgatgattcaaacacaattgatgctgaaatcaagcaggattaaaattttttcggtataaaaaacgcacacttgcaaatttctgctagtgtgtcttttttatatttatatagttaaataacttctaaaaatggaattttcacttaaaaattccttaaattttccggttttggaatttgatcaaacaggaaaatttaataaagcgggttgaaaaaataaaaaaaactttaaaaaaagaaaaataaggtataatttatggcaaaacaagatttttataaaattctgggagttgaaaaatcagcatcactaacagaaataaaaaaagcttatcgaaatttagtaaatatttatcatcctgataaaaatacaaaaaaatcagctgaagaacaaaaacaagctgaggccaaatttaaagaaatccaggaagcctacgaaattttatctgatgaaacaaagcgaaaacagtacgataaattcggtcatgccgcttttgatcagcaatttggtggtgggtctagtggcttttcaggatttgattttggcgatattttttcaagttttacctctggttttggttttggcggctcacaagaacaaaaatatagtcgtcctttaaagggcgaaaattttcaagctaaaatttatatcagttttatcgagtcaattctcggaaaagaaatctcccagaaattaacaaaatacgatcaatgtgataactgtaagggttcaggcgctaattcttcttctgatattacaacttgctataattgtcaaggtcggggaatgcaaactgaggtcttaaatatcccgggatttggtcgggttcaaaacaaaacaacttgttcagtttgtttaggttccgggaaaaacattacaaaaaattgcaaaaagtgccgtggaaaaactatagttgagacaaaagaggaagtaactattaaaattccggccggaatccaggatggaatgtttatccgcgtggccggatttggtggaccgggacacaaaggcgggccttctggagatcttcatcttgagattaatgttcgtcagcataaacattttactagatcaggaaatgatattcatgtgaatatgccagtttcaataattgatattatcaaccaaaatactgtcgaggttcccagcccaaccggtttgaaaaaagttagactttatgattattataaatcaggtcaaattgttaatgttcttcgtgctggggctcctgatccaaaaaatccaagaattattggcgatctcaaggttcatttaattttttatatccccgaatttagtccccgtcaaaaagatgagctcaaccaggtttttgctcaaatcaatgataaaacaaaggcaaaatgactaaaagaatttcaataatcggaaaaattgtttataattttgtataaaagttattaacaggaactacttattataaatgccttttaaaaaaattaatattgcaatcgatggaccttctggagttggaaaatcaacaattgcaaaacaaattgcaaataaattcaattatttatttataaataccggttctttatatcgcgcaattgcttttttttgtcaaaaaaatcaaattagcattacaagtgagcggaaaatgataaagcatttgccaccaaattttttatcacttgattttgaaggaaatgtttgactacaaaatcaaaatgtttctaatctactacgcaatgatcttatctcaaaaaatgcagctatcatcgctcaatacccacaaataaggaaaattgttactgaaattttgcaaaatttccaaaaaaatcataaaggaatcatcatggagggtcgcgatacaacttataatgttatgccagacgctgatctgaaaatttttttatgagcagatgcagagacaagagcaaaaagacgtttaaaacaaaacacttttttgaatttagaaacagattttcaagaaattttaaaggcaattgaacatcgcgattaccttgatatgacccgaaaaactaaccccttaaaaaaaacagttgattcaatttttcttgatacaacaaattttacaagagatcaaattgtatcccagatttccaagttagtttttcggaaaattggtcagttttcacttgaaatttaaaggttaatttttaattaatgaaaaatttagttgctcttgttggaaagtcgaacgttggaaaatcaacactttttaaccgaatagcaggcaaaaaaatttcaataactaatccacttccaggtgttacaagggatcgaatttatcaaaatgtgacctgaaatcaacatagttttttgttaattgatacaggcggaattcaaattgagaatgaaaattttcaggatttagtcagaattcaggtccaaattgcccttgaagaagccgatattttagtttgagttcttgatggtacaaaagaaattgattcagaggatcattttgtccttagtttattaagaaaatccaaaaaaaaaattattttagttgcaaacaaacttgaaaacaacaaatcttttgatataagcctttttgagttaggttttgagaaagtttttccaatttctgccttacacggtcatggagttggtgattttttagatgaacttgtaggtaattttaacaaaaaaaattttaaaaatgagattttttttaaattaactctaattggtcgcccaaatgcaggaaaatctagtctccttaactgacttttaggggaaaatcgttctattatttcagaaattcccggtacaacaagggattcaatttctggtttttggaaaataaatggacaaactttggaaattatcgatactgccgggattagaaaaaaatcaaaactggcagaatcagttgatttttatgcatttttacgagcttttcgctcgcttgatcaggctgatttaaccttgattttattagatgcttgtcaggattttcatcattttgatctcagaattgccggttatgcctttgagagaaataagccgataattttagttataaacaagtgggatttaattcaaaaagacacaagaacacaacaagaatatcttaggaaaattaaaggtaagtttaaatttcttgattgagcgccggttgttttcatttcagcaaaaacaggagaaaaaattcataaactcattgatgttatttttcaagttaaaaataatcttgaaaaaaaaatttcaacaaatttacttaatcaatttctaatggaaattcagatgattcaaccccatccaaatgttaatggtaaaaaagtttacttcaactttttagagcaaatttatggaaaaattcccacttttatattttttgtaactgataaaaatttagtccatttttcttatcagcgttatattgaaaaccaaatgcgcaagtattttgatttttttggctgtccaattaaaattatttataaaaatattaccaaaaaataagaaaataaagtaaaatttataattatcttagttatgaatggagtcattaaaatgaacaaaaaagaactaattgagcaaattgcaattaaaaccaatcttcctataaaaaatattgagcttgttttaaatgaattttttggaataacagcagatgttgtcaaaaaacaaggaaaattagtgattaactcttttggaactttccaaggagttttcaagcccgcatcttcttcatttaatccactaaccaaaacccagattacagtcaatgcaaaaacaacagtgagattcaaaccttcaaaagttctaaaagattttattgcctaaaaatgtttagaaaaaagcaaaaaaagccgaaatttaaatacaaaaccgcaaatcaagtaatttatggaaatgtagttttacaaaaacttaaagagattaaatacgggaaaaaaatagcactttttctccttttatttctcctggttgtcggccttgttttaggtcttgtttttcttattttttattttgcagatagcggaagtaacattgaagaaatagttagtcgtgggtagatggataataaaaaaattcgaaattttgccataattgcgcatatcgatcatggtaaatcgactttggccgacagaattcttgaatttaccaatacagtttcaaaacgtgatctaaaagaacaacatcttgattcaatggatcttgaaaaagaacgtgggattactattaaactaaatgcggtccaaattcgttataattcttacatttttcatctaattgatacacctggccatgtcgattttacttatgaagtttcacgatctttagcggcaactgaaggcgctttgcttttagtggatgcaagtcaagggattcaggcacagaccttggccaatgtttatttggcccttgagaataatttagaaattattccaattataaacaaaatcgatttaccttcggcaaatgttgataaagtcaaagccgagattgaaaacactatcggaatttccgctgaaaatgccattttgatttcagccaaaaatggcatcggtattgaaaaagtacttgaagcgatagttaatttgatcccgccaccacaagcttcagacgaaaaagatcctttaaaagcgttagtttttgattcttattttgatatttaccgcggggtaataatttttatccgtgtggttacagggaaaatttcagtcggggatactttcaaatttatggctaataacttgaaattttccgtgattgaattaggaatttccagtccaaatcaggttaaaaaagaggcgctttttgctggtgaagtcggttgggtggccgcctcaattcgcaatgcaaaagatgttgaggtaggtgatacaatcactttagttgaaaatccggctaaatctccacttcctggatataaaaaattagttcctgtaatgtatactggattttaccccgtggattcacagcaatacaatcttttaaaagattctttagaaaaaatttcgctttcggattcatcaattatttatgaacctgagtcatcaaaagcgcttggttttggttttcggattggatttttgggacttttgcatatggaaattcttcaggaaaggcttgaaagggagtttaatctttcaattatagcaactgcaccttctgttgaatttcagattacaagaacaaatggccaagtccagataatttctaatccgagtttgtttcctgaacctaattttattagtgaaatcagagaaccttatattttagcgaaaatttttttacctgaagaatttttagggcaaattatgggactttgtcaagataaacgcggaatttatgttgatcttgaatatatagatgactttcgtaggcgcttaatttataaattaccgctagttgaggttatttttgacttttttgatcggctaaaatcactttcaaaaggttatgcatcttttgaatacgaggtaattgattatcaagtttcaaaactgcaaaaattggatattttactaaatggacagaaaatcgatgcactttcaatgatagttcataaagattttgcctatccaaaagcaagagatcttacccaaaaattaaaggaaattatcccaagacattcttttgaagtcccagttcaagctgtaattggatcaaaagtgattgctcgcgagacaattaaagcttatcgtaaagatgtaacggcaaaattatatggaggggatgtcacaagaagaaaaaaattacttgaaaaacagaaggcaggaaaaaaaagaatgaaatctttcggggtcgttgatgttcctcaggaggcctttttagcaattttaaaaacaaatgttagtgaaaaatagtgtataatttgagaaaaataggtgaaaaacaagcaaaaattcttttttttactttactaggttaataaatatgagaagaaatagacaaaaatttgaaaattacccctaccagcgaccacaaaataacccaaatttttctaattttgagcaaaaaaacaaaaattttcaacccacacaacatgaatatcaatataatgaagaaaattatcaggaaaattcccgttataggccaaaatatgaaaatacttcgcaattttatcataatgaattattagaacgcgaatatcaagatagaatggaacaaaaacgcattcaggaagaagcgaatacctttatttcaaaagaggttcggaaaatttttggtttagagttaattttcctacctttaaaagcgattttttgactagcattgattcttacagttttaattgtttcagttctttggactcaggaaaaaattccagcttgatcttatgagaaaaaatatttacctttgctaatagtccctggaatttttggcgctattttattttttctttttattaaaacacttttagactataaagcaatcaaaaaatctgttatttattttcgttcccagttgcaaaataatgcaaatcgacttgaaatgccaccaatgattccatgacttgtaaaaaaagtgaatcaaaaagaggtaaatgctatctgacttagcggctttactttgtttgcaacaattatgatgggcttaacttactgagtgttattaaaatattatccggagaaaaatattcaaaattctgccgaatatataactgcaatggcagtaaatggcgctttgtttatagttatgctaatttatgatttaatgcttcgtcggcgtttgggaaatattgaagcaatttttggtcacatttatcataaaagtattgatataggtaaaattcgttttcgccgtcatttactttgagcttttttaacggtagtaatttttttgattttacgaagaatcggaaaacgtaaaaattgaatttagatatattttaccctatttatttttttctccaagtaaaaaataaaaatttttttaactttataaaaagcacttaaatttaagcgcttttttatatttaatagcaaaaataattattaattaaattattatgccaagaatattacaaaaattttgctagccggaaaagttacataaattacgatacttttttaaattaaataagattaattctaataaattgtataaaaaaccgagtttttagaaaaaaatgaaattaattcatctaaaaactcggttttcttaatttttcgatatttttttatagttttctttttttagtcatcttccttaattgctctttgttttacgatgacatcggaaatatttttgggtacaatttcatagtgattaaattgcatctgataggttccccggcctgaagtcattgaacgtaattgcgttgaatacccgaacatttctgcaagtgggacgtgtccgcgaattacatttgccccatcagaacgagtttcctgttcacgaactagaccacgacgacgtgataaatctcccattacatctcctgcatattcagagggagcaaaaacagaaacatccataatcggctctaaaagtactgttccaacagcatctctggcgcgggaaagtgccttagatgctgcgattttaaaggccatttcagaagaatcgacttcatgaaaagaaccatcaaataaagttgcccttaaattaattaaaggatagccagcaagaattccggcttgcattttttcttctagtcctttttgaattgatttgatatattcttttggaattttccccccaacaattttatcaataaaatcaaaaccttcttcaggattaggttcaaatttaatccaaacatgaccgtactgcccacgaccaccggattgtttgatatattttccttcaacttcagcgctttttgtaattgtctcgcgataagaaacctgcggttttcctacacgagcttgaacattaaactctcttttgagccgatcaacaataatatcaaggtgcaattcgcccattccggcaattattgtctgtccggtttcaatatcagttcaagttttgaaagttggatcttcatttgctaatttttggagggcagtagctaatttttcaatttcggcttttgaaaaaggttcaagtgactgggaaatcacaggttcaggaaaattcatcctttcaagaacaaaagtttttgctttttcggaaattaaagaatcaccagttgttgtatcttttagaccaacaaaggcaccaatatcaccagttcttacctcatcaatttcttcacgggaattagcatgcatagctaaaatacggcctacacgttcttttttgccttttgttgagttaattatataagtacctttttttaaaactccagaataaacccggaaaaaagtaagtgatccaacaaaaggatcattcataattttaaaagcaagggcagaaaattcttgatcatcgctagcttcaattgtaatttcttcctcatcacgaaacgctttaattgggggaacatcaacaggggaaggtaaataatcgataaccgcatcgatcatctttttaacacccttgtttttaaaggaagatccgcagacaacagggaaaaaattacctgtaattgttgcagcccgaattgcagcttttaattgttcaggtaaaatttccttttcttctaataaattattaaaaatttcttcatcatagtcagcaactgcttctgcaagtgcaagtcgcatttgacttgctttttcgaaaagatcttcaggaattggaatttcatattcgatttcttctttttggccatcataattataagccttcatttcaacaagatcgataagtccactaaaatcggcttcagcgccaatatttaactgaattgcaactgcattcccgtttaattttgtccgcactgattcaattgaagcttcaaaatttgcaccagctttatccattttattgacataaacaattcttggaacgctataatttgttgcttgtcttcaaacagtttcagtctgaggttcaaccccggattgggcatctaaaacagcaactgccccatctaaaacccgtaatgatctttcaacttcgacagtgaaatcaacatggcctggtgtatcgataatgttaattctttttccttttcaaaaagcagttgttgctgccgaagttatcgtaattccgcgttctttttcctgttccattcagtccatttggctaaccccatcatgagtttcgccaattttatgaatttttcctgtatggaatagaattctttcagttgttgttgttttccctgcatcaatatgggccataattccaatattgcgataatcttttagttcaaattttcgtgccataattctaaattcctaccatttaaagtgggcaaaagccctatttgcttccgccattttgtgggtatcttcttttttcttaaaggcccctccggttttattataagcatcaattatttcgtttgctaacttaactatcattgttttttcattccgtttacgggcaaaaagaattaatcagcgcagtgcgagagtttgttgtcgtttctgtcttacctccattggcacttgatagttcgttccgccaattcgacgagaacgaacttcggtaagcggtgttacatttttaaccgcctggcgaaaaacttcaagtgcatctttttgtaacttttcttctactaatttaaatgctgaataaagaatgttttgagcggtggtttttttcccttctaacattgtgcaatttattgcttttgttatcagtttggaattaaaaactggatcggctaaaacattgcgaacgggagcctgtttttttcgtgacattttatctccttttttaaaaatatgttgtaatttatagtatttttttattttttactttgattttttcggtcttttagccccgtattttgaacggccttgcgatcttttggcaaccccagttgtatcttgggttccccgaacaatgtgataacgaattccgggtaaatccttaacttttccaccgcggattagtacaattgagtgttcttgtaaattatgaccttcgccaggaatataagcattaacttcaattccatttgaaagttttacccgagcaaattttctaagtgcagagtttggttttttaggtgtcatcgttgcaactcttgtacaaacaccccttttaaaaggggcgcttaattttaactcctttttatgcaaagagttataaagcatattaagcgctggaactttagattttcaagtttttttaacgcgacaacctttagctaattgtgatattgttggcattttttcctttattttatagtgttttttgttttagaaaacaacggtatcggtgatatagaattaagatctataaatgcttttaacaagaaaatataaaagaattttaccacttttttaaattattcaaagcctaattttcgatttttatatccattagttctcgtgctaactgttctaaatttatttctttttcatcaagctcttttcttttagtttcataaaattcaagtttttggcttgcctttttataaacattttcaaaaacaaaaaatgaagaaagtgatgttacaaatgtgataattgcgttaataaaagcgattgcaacaaataatttaattgctgtaggattcggatttttagtgattgcataagctgataaaattccattaaaagctgacattagaattaaagcgatactgcagaacaaaaaaataccttttgaaatacgtgcttttgctgttaatttaataatgtcaagttcaatttttgcttttattttttctttattcatcttttattttcctggttttttattttctaatttatttttaagtgcgtttaaaattcctaaatatttagaaattgaattaaataattcaagttgtaaattttttgcatttgcatatttcccagattttgtttcaaataaaataagttcaatttttaaaaagtcattaatttcttgattccgatttcaacgtggttttactaaaaaaagtgcaaaaagtccgttaattattgaaattgaaagattaatccacaaaacaaaaattggtcattgatcaacaattttcccattttcgtcaacataggtaaaaaaatttgcaaatggttcaaatacacttaattttggcgatgcaagtttaaaaatacccattaaagttgaaaaaaaagcaaaaaaaatgctaaaaagcgatactgttcaaaacaaaaattggaaaaattttgcctttacaagactttttttatataagaatttggcaaattcatatgaatttgactccaggcgaacattttttacaatcactttttgccaccaaaaacgatactttttaaaatttttagctttgaaacttcttttttttgaaaataaaaatcagaaatttgttgataatctttttcaaattcctctatattatattcattatcgttttggatttgaaaaaaaatataactgagttctcgttgtgcttttttataatccttaaacttcataacctcacggtaaattgcaagaaataaattaataaaaaaagttaagcaaataaaactggctagaacaattgtcaacccgaggtctgcaaaaattgacttatttggagaattaattaatcgataacggtttatttcaacaataattactgtgattgccagcgaaattacaattatgtttgcaaaaaaaataatccattttatagcattaattccataataggcgatttttttacttctttttagcgcttgttctttgttttcaatgaattttttgagccgttcaattgtttcgttttgtgacattttaccttttaatttaacaattttagttaattttttagttcttaatataaataataaaaaaatttactattttttacttaaaatttttccactttttattcaattataacatattctaatttttctttgttaaatatacagtgaattaattaactaggataaaatttagctgttattttttaaaaaaaagttttttatttatgataatatggtataattttaaaattctaacaaattaaaatcttttaggataataagaacaaaatgtctcaaaaaaaatcaaaaaattttctaactgagaggcaatttattttttatgggcttaattacatcgttggatttggctttattgctacaatttcaaatgtaattagtcaaggtgtttgagggattttagtttttattctaacttcgttgattactctagccgtaatttttgcttttgcaagagcaggaaacaaataccaatctgaagttggtggatcatatgcatatgccaaaaaaaccttcaaaaaagagatggtattctttcaaggttggaatcaaataagtcaaattatccttttttcaggaacaacacccttatttttttcaaatctattaacatcttttgatcctgaaagaaaatgaatttatgttgctatttctttagtaatttatattggtcttattttaactagtgcttttggttttcgtctttcaaagtgatttgtatttacaactgcaatttttaaatggctaactttagtaattggttttggtttaattatttacttaattagcgagtcaaaaagttatggtcaaacttttaaaacaattgcgccttttagtgttttgagtctttccgggtcagttttatcttttatttattcttatggcggttttgaatcattagcgacaatttcaaagaatatcgagacaaaaaggttcaaaaagttgataattttaatctttttaatcgtaatttctagttattttattttttatattatatttttaggattaggaccagaatatttagcaaactttggacttgaaggggtttataaagcgctttgaggttcagcaggcacatccctttttacaattgggcttacttttaataggatgtcaggagcattttcttatgtccaaccgcaagcaagatttatttcccctcttgcagaagatggttttttacctgcatttttagccaaaaaaaataaatataatgagtatcaaaatgcaatttatttagtagttgttgttgcaattttttcaagtttagtttttacaattattccggaaattcttaggatagaaaattcttttaatacaattttagcagccggtaatatttcatttttagtccaatatttacttactatttttacagttttgctttgaaaatgacgtaaaagtgagaatattccagtttgggaaatcataatttatattttaggtatgttaaccattttatttacacttattttttctcaactaccttttattagttcgaaagaagtgacttttgaacaatttatccccataattagttatgcttttgcgattttaattgggtatattgttaagttttccgttcaactaactaaaaaaaagaaaaaaatataaaaaagtagttaattttttacttatttaataaatgtttattatagtttttctaattttatgtttttattttaaaaataccagaaaaaagtaaattttttcctatttttaaaataaaatctaaaaaaatgttgtataatttttttagattaaaaataaaatgatatttatttttcctttttatataaatttaaaccaaaaacaggagttataatttatgaaaattatatcaattgggacaaatcatgctggaacttcgtttctaagaacattaaaaactatttatccgcaggctgaacttgttacttatgatagaaatactgatatctcatttttaggctgtggaattgcgctttgagtttctgatgaattcagtgatccatccggacttttttattcaagtcctgagcaattaaaaagtatgggaattagcgttaatttagaacatgatgtaataggaattgatcgtaaaaataaggaagttactgttaaaaacttagttactggtcaaatttttaaggataattatgataaattagtgtttgctggtggaacttggccaattattcctccatttgaaggaattagtcttgaaaatattttggtctccaaaacttttacccatgcaaaaaccattaaagaaaaagcggttgatccatctataaaaaatgtaattattattggtggaggctatattgggattgaattacttgaagcttttcataaatatggcaaaaaaactaccttgattgatatgcaagatcgaattatcccaaactactttgatcatgaatttacccaaaaaatggaggagaaaattcgtgctgaagggataaatcttcaattcgggcaaaaagttatgcggtttatcgctgatgaaacaggtaaaaaagtagcatttgttgaaaccgataaaggaaaatatgccgcagaccttgtgattttagcaatcggcttttctccgaatacaaaaattttagctgatgttgaaaaaactccaaatggtgctatcaaagttgatcaatttcaacgtagtttaagtgatgaagatctttatgtaattggtgattcagcagctatgtttcataatgtaactgaaaaacatgctcatattgccttagcaacaaatgccgtaaaatcaggaatagttgctgcttttcaccttgctggtcgcagtgatattccttttccaggttatgttggaactaatgcaatttccgtcttcggatttaattatgcatcaactggttattctgaaagaggttgttcattaatggggctcgaggaggttgcaactgaatatcttgaggactgagatcgccctgaatttatgcaggaaaaagcaaaagtttgaattaaaattacctaccataaaccaactttaagattacttggggcccaaattggatcatatgggaaacaatttaaccatacagaagtaatttattttctttccctggcaatccaaaaaagactgaaattaacagaaattgctctttcagatttttattttctcccccattttaacaaaccgtttaactttgtagttcaagtaattttaaacgctttagggcttagttataataaaaaattaaaataattttcttaattttttccaattttcattatttaataaaaacggtttcacttttaaagtaaaaccgtttttttactttttataaaattttagtaaaaaaaaaaaaaaaaaaaaaaatgcagcttgaatttttaggaaaatttttttcaattttaaaaaaatactataaaatcaagtgtatttttgttttttaatttaaaaacatcttttcaaattcaggttcaggattaatactaaaagtctttggaattaaatcctggatttgtctaagatcaattggactagatgaatatagactaaaaattaattgatcttcttggacatattcaccggtttcaacctcaagggagattccagcctcatagtcaattttttggtttaattttgttctccccccacctaaaaaagcaacaatttttccaaaaatcaaggcattttctcatttaatataaccattttgaggtgcaaaaatttgctctttataagcgggaattcaaaaatttgaggactgaattaatgtcagatttccaccttgagcacttaccattttcaaaaaaagttcataggcttgaccagattcaattacatcttttactttttcgcgggctttttcaattttaattttttcaagttctgttaaggtttgagcaactaactcgcttgcaaattcactaagttgggactgatttccttgaagaatcgaaagtgattcaataatttcgtttttatttccaatcatttttcctagcggtgcttccatgttagtgattttaacgatagttttttttccaaattttttccctaacattttaattttactagctaattttttggcttttggcagttcagtcataaaagcgccattaccacatttcacatcaataaggataacatcggccccagttgcaatttttttagacataattgaactagcaattaaaggaatcgaggaaactgtcccggtgacatctcgaagagcataaatttttttatcagccggaacaagtgcgtttgattgggcaacaattgcaagtccaattttttgaacttgttctaaaaaattggcctcagttaattgggttttaaacccaggtattgactctaatttatcaattgttccacctgtaaaaccaagtcctcgtcctgacatttttgctactttataaccaagggaagcaaaaataggtccaataattaaagaaattttatcgccaactcctcctgttgagtgtttatcaattttaattccgttaattttcgagagattaattgtatttcctgaggcgataatttcacgggtaaaataaaaaagttcatcatcatcaagaccgttaattaaaatggccattaaaaaagccgaaaattgatagtcagtaattaggccgctttgaaatccgttgatcataaaattaatttcttcagccgaaagtttatgtttttgtgattttttttcaattatttcgaataaactcataatattaaatagcctcaagagcaatttcaatcatttccacaaatttttcctgtcttgtaaccgaatcaagttcagattttgtgattaaattatcggaaatagtaagaattgaagctgctttttttccgagataattagcgattgtaaagagcgcaaaagattccatctcgactgcttttgcctttgatagttcaatagttttttctaaattacgacttgagtaaaaaacatcggttgagtgaattcttgtataaagtggatttagtcctaactttgtagcactatggaataaatttgctactaaacctggattagggtgggctaaatgtactttttttcccgaaataagtgcgggaaaagagcaagaatctgatcaggctgaattagcaattacaagtgaataaacttcaagatctttatcataagaacctgctgaaccaattcgaattattttttcaacatcataaaatttaaataattcataggcataaattccaattgatccagaacccattccggaagcggcaatagttactttttttcctttatattcaccagtaaaaatcaaattatttcgaacttttgagactaatttagcatcttttagaaaatttttagcaataaattctgcccttaacgggtcgccaggcattaaaactatcggtgcaatttcgttttttttagcttcaatatgtgctgtcattttttctccttatgttaattatcaagtgatattataatataaaaagggcatttttgttagtatttctttgcaaaaaatatctaaacttttatttttcaatgatagaacaggtatgaataattctaaaattaatcgcaagcaaactaaaaaaacaaccaaaaactaggccaaaactgtaataagtaataccaaattcaattaaattatatagattaaaaattattaaagagataaaagataaaattatcaaaataaaataaattctattattcttttttagataaaaattgcagatatctttttgaaatttaacatctttaagtaaactattttttcaaaaaattggagcaattttatccaaaaaagtcaaaaaaataaaaattattagcaaaattccgcttaaactattaaggctaacaaaactaataaaatttaagctttggaggtaatgataataaataaggttttcaaagatcgaaatagcaaaactgaaaagagccaaaagccagctaaattttgttcaaaacataaatgaagaactattcttttgtctttttattcaacttgttcgctaaattttaccatctttgcctaaaaaaaccaagcaaaatggaaaaatttaggaaaaagtgcttatttttccttttttttagttttttcgccagtttttcttaatattggtacggcaaatttaaaacttgattccggcttgatcttactcattcgggtttttagcagtttgttgcgcctctccttttgttctttccaaatcctcattgttatttatatttgttttttcgttattatcttcttcctctgatgatattaattgtttatctgcataatccgcaccgaatatcagtttattatatgcatcaggatcatttttaaaatccacaaattcaactttttggggattttcattttgaatttcttcctctatttcttcaatctctacaatctctaaattttgttcttgtattaggtttttttcttcctcgctcatcatttcaagttgttcctgctgcatttttactaaaatattttgtttttcatcaagaggcatttccttttttaggttaactagtttgctatctccgatttttcaaagttcaaattcctctcctgattcaaccttttcaatttttagtttagcaagttgtttttcaataaattcaggctgtttttcttcttttgcttttcttgcagccgcgattctctcctcgttagaggcgattatttgatcaattatttcttgagggctatctgccggataagaaattgcggttccatcagacaaaattgctttgatatattctattttttcagcatttgaattattaaataaagaaactattgcctgataagcggattctgctactaaaatgttgaatttttttgttgcttcctcggtaaaaatttgataaggatttttctgggaatactgaactaaattagcagaagatcttaatttgtcaatggtgtcaatatgattttgtcactgactatcaagtgttgataaaataatataacgttctgattcaaagtaggtttttccaagattttcctttaaaactgattggatttgtttaaaataaatagtttctaattgtttgattaaaaattcattaagttgttcaatgggataattttcaattccaatttgcccaaagttaaaatgagtaattcttgataaattatcattaagaaaatttattaaatttttatagtgaatttcttgatttggtaaaattataaaatcatagcttaaaatgatatcaacagcccgaataatcatcttctggatataatggtcaaaattttcaatctgaagcaaaatatctctttgggcataaattaaatcacgctgttgacgaataacatcatcataactaagcacagttttgcgcatatcgaagttaaagccttcgattttcttttgggctgcaagtaaaaccgcatgaatatattttcctttaattgccccatttgtttgtccataagcgccaaaaatttgatcaaaattggtaaaacgccgaaaaagttggtcctgaagtgagataaaaaatcgcgaaattcccacatcaccttgtcgtccagagcgacctcgtagttggttatcgattcttctagcttcggctttatcggttccaagaatataaaggccgccaagttcagtcacaccaggctctaaaattatatcagttcctcttccagccatatttgtcgcgattgtaatcgcattttttcgtcctgccttggcaataatttcggcttcaagttggttttgttttgcatttaatactgtatgataaagtcctttttggtttagcatctccgaaagcgtttcagagtcaacaacttgtgaggttccaattaaaattggctgccccattttatgaacacgttcaacttcggaaattatagcttgatttttttcgtgactagtggcaaaaatttcatctttttcatccttacgaatcatcggtttgtttgtcggaatcacattcacgcgcatattataaacatcgataaattcttgttcttcggttttggcagtcccggtcatccctgataattttttaaaaaggcgaaaaaaattttgataggtaattgttgctagtgtttttgtctcaggttcaatttcaagcccctcttttgcttgcagggcttgctggagaccttcagaataagatcttccagccataattcgcccagtaaattgatcaactaaggcaattttgccgtcctggacaatatattcaacatcgcgtttcatcaccttattggctctcagcgcgttttgaattcgatgaactatttctgagttttgaatttcatataaattacgaaggccaaaaaaagcatttgccttatcgattcctttatcatttaatttaattcccttagtttcttcatcaatataaaaatcttcagcaattagagtattaacaaattggttcgcggataaatattgggctggaaggttagttttgccaccactgataatcaaaggggttttggcttcatcgatcaaaattgagtctacttcatcgattaggcaaaaatttagtcccctttgaactttttcagctgctgaaaaaaccatattatcccggagataatcaaaacctaattcagaatgaaccgaataagtaatatcggcattatacatcattcttttggtatttgcatccatttcggttttgttaattccgactgtaaggcctaaaaagttatagacttttccattatcttcagcatctcgttcggctaaatattcattaacagttgagacaattaccccttggcctaaaagcgcattaagatagacaggcgggattgaagcaattgtttttccttcaccggttttcatttcagcaactgatcccatatccaaaattagacccccaagaatctggacatcataaggggttttgcctaaaattcgcttggtcgcctcgcgggcaactgcgaaagcatcaacacgaatatccttgagtttttcgccgtttgcaagcctttttttgaaaatattggtctggtttgccaggtcaaaatcggtcattgcaccataaaaactacgtttttggttaatttgtttcaaaagccggtatgcgagccgtaattcggatgaggttttaaaaaagttaaatagatttttcatcgttttaatatggattttttgaataattttaccaaaattattcaaaaaaataagaaaagtttatcaatttaattacctatgtaatataaataagaaaaatttaggattctactaaaatcttaataattttttattttttataaaaaattatatttttaaattaaaaacttattaaaaagagattttaatttaaaaatacctgtttttcatttatttttgtcattttaataacttattttttaatttattacaaactaaaaaataaaaaagatgcgtaaaataaagcatcttttcagtcttaaataagatatggtggctccgacaggaatcgaaccagtgacacacggtgcttcaaaccgttgctctacctactgagctacagagccatggcggtctagacggggatcgaacccgcgatctcctccgtgacagggaggcgtattaaccactttaccactagacctctggttgcggagacaggaatcgaacctatgacctttgggttatgagcccaacgagctacctctgctctactccgctataaaatttataagatatttttgaaaaagtactataaaataaaggataatttggcgggcaatgagggattcgaacccccgcgggctttcacacccctgccagttttcaagactagtcccttcagccacttgggtaattgccctttttggtggatctaactggattcgaaccaatgaccaaccggttatgagccggatgctctaaccgctgagctatagatccagtttaaatttaatttttgcttatttttttaaaaaaattaaaaaaataagatttttggtggctccaaggagattcgaactcatgaccttccgggtatgaaccggatgctctaaccaactgagctatagagccattttggtggagaggaagggagtcgaaccctctacctcctgcgtgcaaaacaggcgctctagccagatgagctacccccccaaaaaatggtgaagaagacaggatttgaacctgcgaccactacgtcccaaacgtagcgctctgccaagctgagctacttctccaagatataattatacactaaatttttaaaaagtcaaatttttttatttttttaaaatatttcttttaaaaaaataaaaaaatggcgatcacgagaggattcgaacctctgaccacaagcttagaaggctcgtgctctatcctactgagctacgtgaccacgcctaaataattataccattttttatttataatttataattatttaatatgaaaataaattgatttccaggtcatatggcaagaagcataaatgacatagaaaataaagcgcgaatagcagatctttttattttaattgtggatgggagatgccctatttctagtctaaatgagaattttttgcagattgcaaaacaaaaaatgacactagtaatagtaacaaaaattgatttagctgataaaaataaattcactaaaataaaaaaattttttacggataaaaaattttttattctctttgtaaatttacgagattattcagctagattaaaaattctatcacatttaaataaaatatttaaaataaaacaagaaaaaaattcaactaaatttttttcgccaagtctaaaatgttttgttgtcggagtgcctaacactggaaaatcaacgctaataaatttaatcacaaaatcacaactaaaggtaggaaaccaaccgggaataacgagaaataatcaatgaattagctatgataaatttctttttcttgacaccccaggtatcctattgccaaaaatgaacgatcaaattttagccgtaaaattagctattattggtttgataaggtgggaaattctaaatattagcgatctttttattgaagcatacaaaataatttctgaacaatatccaaattttattacagatttaaaactaaaaccctcactaattgattcagagattgaagaaaacttgttgattttgtccaaaaataaaaaatttataaataaaaatggtctagatttgtctcgctgtcgaagatgatttttaatgcatattggcaaacaaaaaattacactagattaatttttttaagaaaattaaagttcattaaaaaaattttttagaatagttaatttttaaaaagatctaaattactatattaatttagatgcaaaaatgcggtatttttcttgttttttgccccgcagaaacaagtttatattttagattttaactttatattttttagattttttgcttttagaagtctagaaaagtctataaaaaggttgcttaaaatgcaaatgagtttttaccacaaactgcaaataaaaattatttgcctgatttttttactaatttaaatttatatgtagtttttttcttttggatcttcttcatatttatctaaataattgttttttaaatcttcaattagttcaagtcggctaacttttttatcaaaaacgatatttttatccttaggaaaagccaggatttggaaggccactttatcaaaactggattcaggatttgtattaaaatttagtgttaaatccgttttaaaaattgttgtcaaaaaaatattattattattattattattttctgtttttctaagaaccaatttttctcattcaaccctttttgaaaaattagtagggggggatataggctggagaacccctcctcaaaatggttcataaccaattcgttcccaagtttcgtaaataaaaatattattattttttagaaattcatcaagtttttcgctgtttagaaatttttcttcaaaatcagaaattaaatcattttggtcaagttttaatttaggatctaattttaaaattcggtcaataattgttgtcttaaattcgtcaatatttttaataattgtatgtttttttggtaaaaaactgttagatcaaggattaattttatttgtaattaaatcaagaatttttggctttaaagttttaatattattaatttcttggctaaaattgataatattaaacataaaagaggggtaagaagtactaatcttgttttttgataaattgtacttttttgcgagtttattataaatttttctagcttctccttcaattaatattttctttcttttatagtctatatttttatcattatggccagtgtaaattttttcttcaatgttcctaaaggtgattgttttatttttagggtagactataacattaaaaaaaggtgaatcatcaaaaactacagcgggttcaattaattttgcatctataatataatctggtgtaaatcttgtggctataatgtttgaaaaaccattttcttcaaaataatagtgggtaacacgagttggttttcaatatctaccacgctcgcctattataatattgtttttttctaagactttttcaagaagttctccttttagaaacttgtcttcaaattctgacttgagttcagaactattaactttagcaaaattaggattattttttataatttcttcagttctatcaacaatatttttttgaaattgctctaaattttcaattgttattctactttgttcaccaaggaataaaaatttgtcccgttgtttttcgggttgattataaaacagatttaaggctgaaaaagtaccattttttgcattaaattcttcataatgcttcgctagtaaatttaaaaaataataagaattataattttctggattgttaattccctcatctttgttaaaaatttgcttaacaataaaaggaattaaatttctgcaggaagttaaaaaaaatgccggaattaaaagggttattcccaaaaatttactaagaattagtttatttttcattattaaccaaataagaaagtgctaatttatcttcaacagaattatcaaaagttacagatttaaattttttgatataaagccgatagtagcctgattcttttgctctaaaatcaattaattcatcattgcttttaatacttgttgaccaagaaacatcaattcaattattgtttgaatcaagtttttgcaaatacaaatcataatctgaaacccaagtgtcattttgattttttttagtagcttctaagtttaaacgttcagaattaatatgtgtttttgaccatttgtcaaagtcatttttatatttgtctatcttagctttagcatctaaaatagctgcagcgcctgcaattgggaaaacaatcggagcaaagggtgttaaaaatcaccatcaacttatgtagttgctcttgtcaggcgcagcaactttattttttagaagaccagcattaaacattcaagataaagaagctttaattctatcgtttgaatttactcagaatggtttgctagtaaaaattatttcattttctgattttttttggtctttaataaagtaggtattttcactagcttttaacatatttttaaaatcaggagtgcctgagccatatttttcaaaataaccgcttttctttttagttaaatcactatgatctggggaaattgccgaagcagataaaattgcttttaatgctattagtctattatcatcattatctaaatttggtttttctcttagcagtgttgatattaagccagtgacaacaggggctgcaaaactagttccgctaacaaaatcatccttagaacgattagtaacaggattataaatccgcccgggagcgacgactaaaggtttggccagttcataatattgttggccagttttataatttgaatagtcagcaattttgtttttggcaatttttcaaggttcagaattatcatcaagtgccccaacaactatagaatttaaagacaaacttcacgcatctattcaagggtggtcctcatattcctcatcagaatattctcttgcaccgttacccgctgcaaaaacgttaataacaccatattttcttgctaaaaaatcaagaaaaaaggagtcttcatcataatcgtaaaactctttttttccacccccataactatgatttattactttaacattattggttttaaccatccattcaattgctttttgtcattgactgttaataccaaatatagacaaatagggagttgacttggtatcaatgcccagtttaccgcctaatattaatgatactaaagttgaatgatatggttctttttgaccttccttttgttcatttcacttattagtagatcccaagtcgttaatatgaaaattattagcattaaaataactcataaaattatagttaaattcatcagtaacttcaattgcgccaacttttgtttgtggtgatttgtaagttaattcatcctttttagtctgttcttcaaaattaacaatcttaatattttttaacaatgattctttgaatttgtcaattggagttttaggtaaataatggtagtaattatctagaaattgatcattataacgataccaacttaaaggctttatttttttatctccttcatttttatatacgatgtaacgactaatgaacgagttttctattgaattctttacaaaaaactctctatcattctcggtatcaaaataaaaccatacaattggtaatattttactgctcttaacttctttgaattttaatcttgatttttctatttttttaataaattcaagattaaagttacttatttctttagactcagtactcaagaaattagggtttaacaatagttttaattcgaattgattatcaaaatcatcaatttttgccgagttactgaactttttggcaaaaggttctcttatatcgattttattactaaaatttgaagcatatcaatattttttagtattaaaatttataagaaaagagtgatatattaaaaaaattgatggtcaaaacaccaataataaaattatttttttaaattttgctaatttcatttttcgcacccaattaaaattatttataaaaattataacatattttgtctttttaattttaagttagtatattaatttcagacacattaaaaaaaaggtgtctcaaaatgaaacaatacaaatttaaatatatcaaaattgctgaaactaaatggttaaaaattgcaattttgcattttccagaagaatttagagaaatttacaaaaacaaatctaaaagtaaaaatgcgcataaagaatgaattttgcatatatatggtaataatttaataagaaattggaaaaaagttttataataatggtatgaaaagtctaataagtgctcgtgggaaaaacaaatctccatgcagaccaaaaaagaaatatacaattaacgatctttctgaaattgatcgtggaatttatcaagaaataatggagaatgttcttagaagatacggaattgaccccgcaattgttcttgaggagcttaaaaaacgaaaacaagaactagaacaacaacaaaagcaagaacaagaaaaagataaagataaagaaaaaatcgaaaattaagttagtatataaactaattgtctgaattttttctactaacttaaaaatatgttataatttttcttaattatttttgtgtagagagaaggtagtaacattttttaccttaatccttcaagtttttatttatctctttttgtaaatttattagtttttcttctaataattcttgctgttccgattttactagttttattagttgcttttgtcaaaccgcggattaaacaaacatcaaatatttatctttattctttaagtagtggacttttgttgatggttgcaactgttggacttattcaagaaggttttcatggggctgaagcattcagtcataaatttgaaaatttagaaaatttatataaaattttaataattggcgggggagcactttttggactagttagtgtttttattgctcgttgattttttattagaatttttaaaactgaactacattcagatcataaaaagcatgaccatagtgatcatattgtaaatttttctgatgttgatagtccaaaaagtgcttgacttgcgatacttcttttactttcacaccgaacaattgatggctttattttaggttcagtaatcgcaagagtaactgctggggacccaataaattgatatttaattggaacttttatagctcatatgttaattgaagttttaataattcactaccgtcaagttcagtatggccaaagtattaaaaaatcagtaatttataacttaataacaaccctgattttagtgccgattattacagttggcgcctttttgaaccgtttttttattaaaacaggctgactaataccattttttaatgtttctggcggggcaattttaagttttgttgtcataattgagttagttccagaatttatccatttaagaaataacccttcttttcagtgacatttttctctttttttgtttgctttaggaattattttagccttaattattttaattttacatgaacattaagcgcgtagatccacaaaaatactataaatttatagtatttttgtcgaagagtaattagataaattcctgaaattgatgtaaaatttaatataaaaatttctaatttttgttaatttttaaaaaaatttcataaaagttagaaataagcctaaataattatttaaatttaaattattctttgttttaaagtattttttggtaacaaaaaattttttgattaattttaaaaaatatgttataattattttcgagctacaaaatgtatattaagctttggtttagttcaaaccgctcagatgaacatctttgactttgcagttgtagttaaagcaaaaaactgcaccaccaaatttatttggtggtttttatttaaaaacaattattttatatttaaaattgtttttaaataagcgccagtatatgattcactaacttttgctacagcttctggtgttccttttgcaactatttggcccccgttatccccgccgtttgggcctaaatcaataatatagtcagcaactttaattacctctaaattatgctcgattacaattatgctatcaccgttatcgactattcgatttagcactttaattaaattagcaacatcataattatggagtccagttgttggctcgtcaagtacaaaaagtgattttcctttaggttttttttgtaaaaaagtggctaatttaattcgttgagcttctcctcctgataaagttattgctgattggccaagttttatataaccaagaccaacatcagctagggtttgtaattttgcgattattttaggccaattatggaaaaattcaagtgcttctgaaactgttaaatcaagaatatccgcgattgtttttccataaaaacgaatttgtaggacatccggcttgtatctttttccttggcagtgatcacataaaacataaatatcaggcataaaatacatttcaattttaatttgcccgtctccttggcatttatcacaccgcccagtttgcagattaaaggaaaattttgactttgaaaaaccaagcgctcttgcctgctcagtattggcaaaaacctcacggatatcatcaaaaacagaggtataagttgcgggatttgatctaggggttcgtccgattggactttgattgattgcaatcaacttatcaatattaaaaagccctttaatttcctcacattttccaatgcgaatattagttgttccaagatttttggcaatcgcatttacgataatttgattaactaatgtcgactttccagatccagaaacaccagtgacaacaacaaatttgcctagaggaatgttgacattaattttttttaaattattttcagcagctttttcaataattataaatttgccattgccagcccgtcgtttttttggtactggaatttccaattttccagttaaaaattggccggtaagtgattttggttcattttcaatatccttaattgatcctgcagcaaccaaaaaaccaccgttttcaccagcttttggcccgatatcaacaatataatcagcagctaaaattgtctcaaaatcatgctcgactacaattaaactattaccaatttcaaccatttttttcagtgtcgcaattaatttgtcattatctttttgatgtaggccaattgaaggttcatcaagaacataaagaattccggttagttgagatccaacctggcttgcaagcctaattcgttgggattcgcctcctgataaggttgccgttgatctatttaaagttaaatattcaagaccaacatttgctaaaaatgacagtcgtgatttaatttcatcgagaattaaagtagaaatttttccgtcaaattcagttaattttaaatttctaaaaaaagttattaaatctttaattgaaagttgggataattgaaagatattatacttttcaatgaaaacggcaagcgcatacttgttaagccgggctcctttgcaactactacaaggaaattctgacatcattttcttaaatcaaagtcgtaaatcttcgcttgatgtctcccaaaattttctctgaattttattaagaattccttcaattggtcgaaaatagtcatatcttttcccgctttcagaaattagtcagtaatttagagattcttttgatccatatttgattatttcaagctcatttttcttcatttttactatttctagatcagccgagatttcaaaataatcaagtaaaattttaaattcttgtcattcaagtgattttgtatttattgattttccaaaatatttaatcgctccctgatttatagttaaatttttatccggaacaataaggtcaaaatcagcctccaaatttgtacccaaacctttacaaacctggcacattccataaggtgaattaaaagaaaaaagccgattttcaagatttggcatctcaaaatcaccaaaaggacaggcttgtaattttgaaaatctgatagtttcagattcattaaattcacaaagggcaattccttttccaagatcaaaggcaagttctaatgctgactgaagtcgatttttgtcctctttttcaagcaaaaatcgatcaatcactacccaaattgtgtgcttctgttttgggtcgagtttaatatcgtcagctaaataataaaaagatttattaatttttatgcgcaaaaacccttgatttttaagatttttaattaaattttggtgactccctttttcaccttcgataattggcgccataattataagttttgttttttcaggatatgctaaaattgtatccaaaattgtgacaattttttgagctataatttcaactttgtggtttgggcagaatgctttcccaatttttgcatataaaagccgaaaatagtcataaatttccgtaattgtaccaactgttgaacgcggattgttatgacttgttttctgttcgactgaaattgtgggtaaaagcccataaattgcatcaacttttggcttttttgtcccacctaaaaattgccgagcatacgaacttaaagaatcaatatagcggcgctttccctcctcataaatagtgttaaaagcgagcgaagatttaccagaacctgaaagtcccgtaaaaactattagtttattttttggaagaacaagattaatattttttaaattgttttcgcgtgcgcctttaatgtagataaaattgtgagtgtctttatttttaagcatttttcggtattttattacttttttgtgaggtctttttattattttctttattaattttagtatttatagcagtaataaaattagattttttaaatttttttgggctttttggtatattcagttcttgttttttcgtttgaaaaagggtattttgcttcttattttttaaaggataaagtttttttctggctaataaggcttgtggatctcttgaatttttaacattttctttattattataaggtaaattttttgagtttataagacttttttttatcttttttttagcatcattttcatagcttttttttaaattttcttttttaaagaatactaagttttcggtttcttgaggatttttatttttaaatttatttgggtttttctgattagaatttggtgatttttctattagaatatcactttgattatcattttttgtttttcttaaagtggaatttatttttctagtcacttttttaattgattcatttattttattttcttgatctttttctgccttagaagatttgacattcacatttttttgcctaatttgtaaattttgtacttttttatttaaatctgattttttagctattttattataattttgttcagtttttggatggttttccatttttttgccttttttagttggaatttctttatttttttcactttctttggtaagattagttttaattttcttaaccacaaatttttccgtggttttttcctggtaattttttagaaaatcttctttttgatcaacataaagaatttgtgttaaaattactggttttcaacgttttgttctatggaaatacgaatttagccgattttttattaattgtttaatttgcggtggtgatcattttggctgtttttcaataaaaaacttaattgatgcaaaacaaagtcggcgaatttcagcaataatttgtgttccatttttagttgaaaaagctccttttgtaataaccgaaattcgcccatttattgaatttttttgtctatcaaatggaactaagacaaaaacaaaaccattttcccgcatttcttgtcgctcattaataatccgggagttatcccgagagatagtctcaccgtcaatataaaccggatcacaaggaattttttcatttgttttataaatttcttgattgtacattttaaaaacttgaccgttttcagggataattacattttttggatcaactccggattcaattgcggtccgcgagtgggcaaggcacattcgatattcaccatgataagggaaaaagtactttggttttgttagttgaaaaattttttcatgttcggctttataagcatgaccggaggtatgaagataaccatcaggtccattttccttaataattgcgcttaatttatataatctattgatcaaatgttcaattttaattttatttccaggaattggcgaagaggaaaaaataattagatcccgaggttcgatgctgatttttggatgttttctgtttgacattcgatccaaagctgcaagttgttcgccctgggatcctgttgttaaaattaacatctgattttcctcaacaccttctaaatttttaccaagaaaaacattatcatcaacatttatatatcctgaacgacgaccaatattaattccgtttaccatcgagcgcccgaaaacaaggatttttttttctaattttatcccaatttcaattagtgctttaattcttgttaaatttgaagcaaaagcggtgatgataatttttcttgtagcagatcgcatatgcatttcaatatcacccagaatatcccgttcagaaggtgaatggtttggcctcattgcatttgttgaatcagaaaaaagcactgttaatttttggttcccaatttcttttagtctttcaaaatcggtataatttccaattggggtataatcaaaacgaaagtcgcctgtgcacataatcgaaccatgtctagaggttattctaattccaaaagcatccgggatagaatgctgggcggttcagaaatcgactgtaaaactttcaaaacgatgagtatcgttcttgttgatttcgataaattcaatctttggcctaattttttggtcctcaaattttgcttttaaatattgaatagcgatttttggggcaaaaatctttttaatatccacttcttgaactaaaaaaattattccgccaatatgatcttcatgaccatgagttacaaaaagaccacgtattttagcttgtttttcttgcagatactgataatttggcaccattcctctaatgccggtatgaaaaaggttggcaaatttgattccagcatcaataattacaatatcataatcatcctcgataactaaagttgacttaccgatttcctgcataccaccaaggccgaaaaaacgtgttggattcaccattaaggacataattttcctaacaatattatctttttttaatttttttataataatttataaatttataaataaacatcagcaataataactatcatttcaaaaaacgatagtttaaagttttttaacttcataatcataaacttaaggtaaaactttaagattagaacatattttagcagatttttttaaagaaagtagcaaaaattagtttttacagacgcgaattagtcctggattatgtaaatctagcttaaattgaccttcataagaccgcaaattatcaagaatttgctcataaagatggccaaaaccaataccagaaattaaattaatacatcttatttttgaattttttaattcaaaaataagattttcaacaacagccgctgttttttggcgatcaaatccatgaaaatcaaaagttttttcattataaggataaaaatccttaatattagagttggatttgattgttaatttttggatttcatctcaatagccaaagtgaaattttttctctttctttccaaatttcattcttacttggatttcatattttataatattttttttgttttaaatcaaaaattcaattaaataattataccataaaatttaaaaaatttattaaattccatttttatttttatattttaaaaataaaataaaaaaaattggtaaaattacaacaaatggaatcaattaaaaacaaagaaataaaggttaaattagtcgatagcgggaccttaacctacaaacttttagaagcaggcaatcctggtgactgattttcgctagtaagtgagattcaaaattatattgaacaaaaaactaaggaaaaaataaagcagaaattagaatcatttaaatcacaaatccgaaatgatatttttacaaacgatgatgaaataaagcaaatgaaggaaacaattcgcaaacttagtgatgaaaatagtagcttaaaaagtgaaaaccaaaaagaaacagcaaatttaaatactacttttactcaaacaattagtaaaaaagatatcgaaataaccaatttaagaaatgaaattggcaaatttcttgatgaaaaagataaaatgcgaagtgacattcttgcaaatgatgatgagataaaggcgatgaggagtgaaatttctcaactaaaagaagcaaatgccaacctacaaaatgtcaagttagaagaaatttcaaatttaaaactagaacataaggacgaaattaatgaaaaagaccgtaaaattagttatttagagaataaatttaacgacttggaagaagaaaaaaataattcaattcaaaatgctgtaagtcaaaaaacacgagaaataaaggaaaaaattgaaaaagagctagaaattaaatgggaagaaaaaataaaacaggaaaaatcagatttaagagaaaattttaaggagcaaattaataaacaagaagaaaaaattcaagatttagaagaagaattaaataaatataaagaaaaaaatataaattcaaaagaaattggtgaaaatttagaaaactgaattttagaacgttataaaagtgttttcccacttgaccaagaaaatgatgaaacgattagttttagtctaaaaaaagatacagaaaatcttcgtgatgaaggtgaaaaaaaagcaactaaagcagattttatttttaccatttttgacaaggaaaatgggattaacgagactgtaattcttgaggcaaaatctgagtcaaaacaaaaaccagggaagcagaaaaataaggattttttcaaaaagcttgaaaatgataggataaaaaagcgagcccgttatgcaattttagtaacagaacttgaaccagatcagtacatcacgattgaaattgcgcctaaattcccaaagatttttatttgccgcccccatttttatctagcacttttaatgattctaaagtcaatgataatcaaagaaaaaaaattaactaaacacgttgaaaatcttgaagaaaaagaaaaaataattaaagattttgaggattgaaaaaataacaaagtggcaaaaacagccgaaaaaataagaaaaaaatctgaaaaagcaatggaatctagtcaaaaaataatcgatgaagctacagaaatccaaaattctttaaatgaaatctcaaatactttaattagaaaattagaaaatacaatcaataattttaaaattacaaaactcgctagaaaagttgaaaaaattaaagaaaaagagattcattcttctaattttgtttaatttttatcgtaaaaatacaattttaatattgattttttattctttcaagattttttgcatatttttcaaggtatgcttgtgttacttgatcaatatttcagtttagtatttcgataaaacctaggaaaaattcaaataattctattaaaattttttgatttttttctagtaaaaattgagaagctaagataaaaacccgtttaaattgattattaatatctttattttgaacaaattttgtttcaaaaatttgttttgttttaaaatgaatacaagctgaaactaaaaagtgaattgcatcaacaaattcttcaatagttttttcataatttgattttttattaacttttcaatatttaaaactttcaatttcgttggcaaattcggcaatttctacaattgcagcgattatgactttgtcctctcattttgaatcaattccggattctaaatcattatgagaactatattcagcaaaaagattgtctagaattttttgtttttcaaaaatgagttttaaatctaaagtcataaggaaaaagttttgaaataatctataataaatataaattatagcatattttttattttttgcaagtttttttgtcaattaaacttggaaaacttgcaaaatcttgagttttttatttagttcaagatttttaatatttttttaaaattttaaaaaaatataatttattagaaaaactaaaaatctcgctaatttacaaaaatccttaattttatagtataattaagataacttgggggtttagtataatggcagtaccatggactccaaacccatcagtgaaggttcgaatcctttaacccccgccagttttttatctttgaggattttatttctcgattttttttttgatttaaaaagtaaaattatttcctaattttaatttttttactttttaaatcaaataaatatttaattaaaaagcaaaaaaattttaggtaaggtaaataatgcagacaaaatttaaaaataaatcatataatttagtatcttcattaattcagccagggcaaaaactagaattttctgtaagtgatacaaattttgatgtagttgaatttaattcctttggcaaaacaacattaatttcggttttcccatcaattaataccaaaatttgtgattttcaaaccgtttcaattcgtgacttatcagtaaaatatccacaatttcggtttatttcagtttccttggaccttccttctgcgattgcccaatgaaaagatgctaatttagcggataatttagaaatttattcagattatcgtctccgcagttttggtcttgcaactgggtttttaatcgaggatgtatttttattaaatcgcgggtatattattgttgattctggtggtagagttttagccgttgagtctaattcagatgtccatgatcaaattgattttgttaaattagaagaaaatctaaaaaaattttcctaatttttttaagtaaaaaaataggaaattctaaattaaaaattatttacttttaaaaaagcactataaattacgtgcttttttattttttagtaatttatattttacttatttgaatgcaagatttaactctaaattttgaagtttgtttcataaaaaatttcaaaatatatcgttaaaatttgattagtccttttattaattagattctccaatcgatcaaaattgtatttatattattctaaatttagattattttcatctacttcataataaatctgctcacaaatattttcccgacaaagtggctctaatttactataaatttcttcggttaaatttgtttttgtaatatttgcccaaactcacttacatccatcattactttttttactatttgtatccttatttaataatattaaattaccaattttacaattattttattaaaaccaaaaaaaattgataattatttatctaaatgcttaattaaaaaataaaaaatggtataattattcaataaaaaagttagtgctaaaataaaaaatgacagataatacaaaaattccaccggatttaatttcagaacgcccttttaaacaaggtgaggctttttggttaattcaagattgggttccaatttatgctcttactatggttttaggtatggtcgcttcaattattacaatttattttttctgaagacgggaaggttataaatttgattatttagccattttaatttttattacagttccagtttcaatcatcggggctcgttttggatttattctcgagagattattttatggggattttaattccttaaaaaattggtataatatcagaagtggtggcctttcaattcaatggggtgttttttttccaacatttgcaaatttaatctatatttatcgtaaaagaagcattcttgactgacgtaagtgtttttccattattttaccagcagttttagttgggcaatttatcggaagatgaggaaattttactaatcatgaagtttatggtcatcttgatccagaaggtaaaactgttaattgattaggcagttttatctataaaaatatgtttattagtgatgagatcgctcctgatggacaactccgggtacccttatttttctacgaatctctagcttcgctttttggatatctagttcttgtttgaatttttaaccttttttcttgattaaaaccaggttcaacgggcgctttatacattatttattatgggattgtgcgatcttcaatggaatttttacgtcaagaatcttatttatattattttataatcgcaattttgatggttttttttggtttgattctctttattcgttttcaatttttgacaaattattatttaaaaattgaaaacaaaaagttaaaacttgctttttttgagcgctacaccaaagaaaaacaaaaatatgtaaatattccttgagtttattgaaaccgaaatcctttgaatttagatagacacccaagaatctaaaaagttagtagaaaacttataatttatactataaatagtaaaaaatcaaagtaaatttgaaaaattttctactatagtaattttttccgatttttagaataaaaatattataatttgtatataatttattataatatttttatgaaaggtgctttgctatggaaaattatgatgtaataattattggtgcaggtcctgcgggtctgacaaccgccctttatgcctctcgtggcaatttaaaagtgttaattctggaaaaaggtgccccaggtggaaaattagtctcccagtcaaaaatagaaaattgaccaggggatgagataattgatggtgcaacattagcgcttagaatgtataaacatcctttaaaattcggcgcaaaacaccgcttttgcgatgtcgattttatcgaaactgaaaatgaatttgaccataaagtttattgtaaagacggaaaaatttttcaaggccgagcagttgtagttgcttcagggatggtcgaaagaaaaccgcttgatataaaatattaccttgaatatgagggaaggggtgtttcatattgtgttgtctgcgatggtcctttttatgcaaatcaacctgcaattgtaataggtggtgggaattctgctgttgaagaaggtagttttttggcttcaattgcttcaaaagtttatattttggttcgtgatagccaatttaatgctgagccaatgttgatcgaagatctcaaaaaaaataaaaatgtcgaaatttggtttaatgcaaaagttttagaacttaggggaaaagatcagttagaatctgctctaattgatcataacggtgagaaaaaagtacttgaaattaagtcactttttccttatattgggtttttaccagctacaaaatttttagaaaaaaaccataggcaagcattaaatcaaattaattttattgatgttgattcttatggtcagacaaaaatacccggaatttatgctgtcggcgatgtagttagcaaagaaattcgccaaattgtaacggcagcaagtgatggtgctatagttgggaaaattttaactaaccgaattaaatagaaattaaaaaggggcaataaggttgtgaaaattgttaagaaaataaaaaaaacaaaatatttaacaagaaagtcaaaaattttgttaggcctaggactaagttcatctattctgggaattcttggtatttcagttgcagtatcttatggtcttgcagtaatcaaaaaaaattcttataatacaacaattgccgatctaaatcggctagcccaaaaaattaatggacttagttttaatgcccaaaaaatttctcctttttcaacttatgcaagtctaaaaaaagagtggaaaaacttagaaagtagtgaaaaaagcggcgaattttttgatttttatactcttaattacaaaagattacaaccttataaacttcccaatggcatttgagcagagtttctaaaaattgaacctgatgatgcaaatcaacaatttaatgtggaatttgtgttaaaatcctttaacggatcaagagttataaaatctgatatcaaaagtgaaaaagtagccataagtccaaattctaccttttttttagagaatttttatcaagctttagaaattgatctgaaaaatattagcccttattctaatggtgataaaggtaaaaaaaaccctaaaaattgactagcaagtgattttttaactgaaataaacagccatgaaactgctcaagatgcaattaaaagaattcgtgatttttttaattttgactttgattcggtacttaaaaacaaaaattttgctattaaatataaagataatttaatttttccttataaaatcgaaattcttaaaaatgatgatgacagttggataaaaccatctcaattaaatcctgattttcttgaaatacaaggtagagttagttttactgatcaagcaaaaaaattatttccgaaaagttttaacacaaatattactaaaaattttagctttttactttttgatttagcattaaataaatctgcatttgctgacccgaaagtttttattagaattccgaaattagttgagccaaaaattgatgaattttcaagtgaaaatccgcaagaaaaaattgatttgtcgcaaaagtcaattttttgaatttataattttcttaaatataaggaagataatatatctttaaaaactccagaagaagccaaaaatgcactaaattctttattaaataatgatttagagcttgattttagccaaaataacaatttagaaccaaatattaaagaaaaatttgaatatcaacttttagttgataaaatcaacttcaatagcgatcaaaattcatcgtttattaacatcccttttgaaatttcttatccgcttgatagcgaaaagaaaaacaaattaaaaacagaaacacaagttttactaagaaaatttaaaaattcatcttcatttgatgctacagtttttgatccaaagaatttttctagtcttccgatagtcaatttaaaattcattagtgaaaaaaatcgcgataaagacgatatttttgaagcatttgaaacagtttcaaaattcgaattggaaagattattaaacttaaaccaacagcaacaaatttaccaaatcttaacagatccgacaaaatttaatctaacttttccggaaaaagagattcttgatgcttggatttcaagttataatttcccatcagttcaagaatttagcagaagaaccttagtggccaaaaaacttgaagatggtagtcaaagccgtcctttttttgaaaatagtcgtgaatttattgcttttacaaaaaagattttatcccttgaaaaggctgaggcaaaaaaatatattgagccattttttgaggcgcttaagactgagatttccgaaaaagagtcaaaaaaactagaaaaaaaagcaacaaatttaaaccaaaagacagcgaaaaatagttctacaacggcaatttcttctgaaaaaaatgaaaaaccagaaaaatcaatgtctgaaacacagcccgagttagtaaaggttcagcaaaatcagccaaaaaccgaagaagaaccaaagcaagaaactgataaacaagaaaaatacaacgaccaaaaaaatccagaacaagctaaagatagcaaggaaaaggaaaaaaacgggaattcgtctttaaaaagtccgaatttacctgcggaaaaatcctcagattcccaggatgaaggtccaaaaactgatagattacagcaagaaaatgaacaagccgcttttaatgataaaatagtttctattctgcaaaatcagtatgaaatttcattaattaaaaatctaactaatcaaattgaggcattaaaaaatagtccagaaagacaaaaagtcacattggatgcggctagttttactgatttatttattgaaacttataaaagcaatgatttagtttcgcaatttgacagttttgccgctggtcttaattataaaattgtttttgtagcaaaccaagatgatgagataattgatcaagttcaactaccagaaccaggaaaatctaaaaaagcagaaaaaaccccggattttaaagaagaatctgagaagaaagaacttgaaaataaagaaaattctcctgccgttggacaaaaaagtgatcaaaaaattagcctaagtttttttcaagaagaaaaaaataataatcaaaatcagggccaagaagaatctgacaaaaaacagcagactccaaaaacagctcaagaaaacagtcaaaatttagttcaacaaccaaaaccagaacaagaaactgagatttttaaacttggttattattacatttttactgcgcctaatagtgaaaaaattgttttccgcacaccaattaagtcgttaaaattaaaggtttttttagctgaaaaaggtggaattacacttgaaaaactatcttataatatgctaaatttcccccagtccttactgaaattagagcttgctgatagtaattttacctctgctgaagctctgaaaaaacaacctgaagacattctaaaagctgaatttagttctcaagataaggattttaaagcaacaatgaatagtttcaaaaagctttttggtaataaaacatttatgaaaatttatcctttacttagcggaaatggacttatttacaaagcaaatagtgtttttaaggacaaatttgggaatttaaaaattagatttgcagttaaagacttagatgcaagtgagaaaaaacagattgtttttccaaatattttggaaccagaactagaaaaaaaagaacaggatgttagtccaaaagcaacagaagctgaaagtaaacaagaaaaacaagaaaaatctcaattagcttcagattctagtcaaacttcaataacatctagccaaaaccaagaaaataatcaaaaaaatcagcttgaaattttcaaacccgcagaaaaagaagcaaaatatccacttgtctttacagtaattaaaccaaatcgacaatttaggagaaactagttagatctatgaaagaaacaaaaattaaaactgttgaaaaagtttcaaataaaagagcgctgatgattatggcgacatgaccagttgttgctggagctatttttggtttttcttatctaacttatgcagtaagcgagtcaaaatattttaaaaaggttgatacgcgaaaattagaaacaacagatttaagtcaaatgggaatcgacctaactaataaaaagtttggcgaaattatcgacaaacttgaaattgacaaagattttgtcaagtattcggctaatcaaattcttgaattatctcgtaatttacagtctaattttcatttagttaacctttttaaccttgcagattttagtacaaaatacccatttttaaaacttaatatcaacccgattgataactctgatgttgatgataaaaatttggttacaaaagttgtaaataacaatttagttaacgttgttttttccgctcatgatcaattaagcaataaagtttattcaaaagttcattcaattcgtggttttagtggtaaaggtgagattccttttgtgaattttagtgttgatcagcaaaaatccgcttttgttttaaagcctgttgagattagaaaaaaatgaaacgcactttctttgattgatagtttaaataatgactataaaaaaactcaggatgccaaaaaaacccttgaaaaatacggatcttttttattactagattcaaataatacaattataaatttcccagaaaaaactcactttgattttaaaaaggatgaattaggtgatatagtttttaaaaatctagaagatccaaatggaaatttatgaatatcatttgatatttttgatgaaaataacaaaagaattcgttcttttgatctcaaagttacaaatttacttaattatcgtgaggtcacaaattatcttaacaatttattaaaaaaagaagatgatttaattgagctgaaaaacgaaaaaattgaggaaattgttgccaaaaatgtttctttatcaacttttttcattagtgcaaaaggggttgatcaattttttgatatctcaaaattagaagcactttttactaattcattaccaaattttgctattaaattattcgcgaccaacacacaaatggatcgcttaagcgaagtcgaactgcttgttcaaattgattttcaagcaagaaaaggtttaattgctgaccaagatcaagcccaaaatagtattgagtctgagcaacttggtcctaaaaatttacaaaataagcaggaaaatccaaaagatattactgtttcgaaccaaggacaaaataaatctgaaaatcttagtgctaaaaaaatcgaacctgttttattccagcaacaaaacaaagctagaagcactcaagcgaaaggcccaattgataaagacgctgaaaaactcaaaactgagataaattaccgtaatttcagctttgtttatatattaaaaccttttaaagatttagcacaacgctatcttaacaatgtaattaaaaataataattattatatcataaaaaataattttaattattttagtggtagtgaaattattaataatttaaaaaaaattaatgctagtttttattcttatgaggagaataaaaacacaaataaaggctatgaaattgttaatttagcaagcagcccaacttatgatagtctggccagtcagaaggcaattgtgtcctgatttaaagacttttttaaggatgcccttgaatttccagttgagaaaaatactgataaaactcttaaacctgaagaaattttagcagaaattttcgctaaaatgaataatataattaattccaaacaaattttttcttatggagttaaatataatttattctttgataatattagccgagaattaaaaataacaattagtattcaagatcgaactaataaaattttaggccaaaaagatataaaaattgccggacttgccccatcaaatccgccgctttttgttgcaaaacaaaattctgctagcttttattttgatggagggggtggatttgaaacttttgatcaaaatagtttaaatccaaagataattaaaagttttaaatcaattacaaatccgcaagtttctttaattccagataaaaaaaatactggtgatccaaatccgaacgcggtaaaaatagttaagaatttaggggctttatatccgagtttaaatgatgttgggcttaaatttgtttataaggatcctgcaaatccggagggttctgactgaaaagacgtagaatttgatccgcaaaaaccatttttttatggtttttcaattcaaaataatttagatgtaaataaatataaaattgttttgaattttacaacccaaaaaaatcaagcacaaaacataaataattcagaaagtaatctaatttgggtcaaaaaattatcaaaaaaaagcgagattaacttacaaaatcagcaaaattattccgaaattcccgataatactccagtttggctagtaggcatttccaaaaaaagcgaaattgagacagcaactacaactgaaaattccgttaattccaaaaaaattatcggaattttacctgtttcaaaaggtgactttactaattttgtgctttcttataatggatttaatcaagattcaaatcaaaataacgcctccacaaataaaaagattcttataaaagtcgtaaatttagaacaaaaagatcaaccgggcatcgaattagaagaaaacttttggcaaaaaaacccccaaaattctgatacttctagtcaaaacgagaaattatctttaattcttggggattccgaaaataacaaaaaccacgtaaataccgaggttttgtttaaatttttcacacaatttgattatcagtttgaggataaacaaacttttagaacagctttggaaaattctttaaaataaaagattaattttcgctttcattaagatgcaatttatcatttttaaaagataaattgtattttttatcttttaaaatttcttcggccactatttttttggcaacaaaattttcaatttctttcttaataaagcgcttaattggcctggcaccaaaatttttatcatatccaaactctaaaattcaatttttgactgatttttcaaattcaatctcaaaattattttcctttagacgattttgcaaatcctttagttcaagttcaataatttcaaaaattatatcataatttaaaggattaaatacgataatttcatcaattcggttgagaaattctggctttaaatatcttaaaagttccttttttgcctcaatttcattcatctttttaccctcaagaattttattagcaccgatatttgaggtcataattataattgtattgcgaaaatttactttttgtgacttactatcaacaatttcaccattatcaagaatttgtaaaaaaatgttgattacttccggatgagctttttcaatttcatcaagcaaaataatcgaataaggatttagtcttactttatttgttagattaccaccttgttcaaaaccaatataacccggaggagccccaattagctttgaaacactatgtttttccatatattctgacatatcaagacggattatttggtttttattattaaataaattaagagctaaagctctagcaagttcagtttttcccaccccagttggtcccataaagaaaaatgatgaaattgggcgggattcatcattaattttagctttaaaccgcaaaatcgcatctgaaacagccttaattgcctgattttgacccttaagcgattttgctaaatttttttctaaattcaaatatttttgaatttctgattctaaaagtttttcaatcggaatttttgttcaattagagacaacctttgcgatctgactttcgtctagaacattggaaatttcctgccttcttgctttaatttcgcctaattttttacttattttgggaatttttccgtatttaatctcggcggctttttggtagtctccttgttccattaagtaattttgttgatattttagtttttcaagttcctgggataagctagcgatttcagaggctgatttttttgattgatcccattgatcttgtaatttttttacttcattttcaagattttcaattttggattttaattctgaattatcttgtttttgcgagttaatttcttccatttttaaataaattagctcgcgctttgctttttcaagtttttctggttggtagttgatttcaacttttaaagaagcagcagcttcatcgactaaatcgatagctttatcaggtagaaagcggtcaaaaatgtaacgatttgccgcttttgtagcaaaaacaagagcagaatccttaatttttacttgatggaaattttctagcctttccttaattccccgtaaaatattaattgtatcaataactgaaggctctaaaatttctactttttgcattcttctttcaagggcgccatctttttcgatatataagcgatattcggaatttgtggtagccccgattaatttaatctgtccgcgagccataattggttttaggatattggcaaaatccattgaatcagtcccagaagatcctgttccaattagaaggtgaatttcatcaataaaaataataacttgatcggaattttgctcaatttcttgcaaaattgccttaattcgtttttcgaattcacctttaaaagaagcacctgcaagaattaaggttagatctaattcaaaaatttgtttattttttaaattatccggtacttgatttgcaataatctttagagccattccttcaacaattgcagtcttacccactccaggatccccgacaaggacaggattattttttgtttttcgggataaaattttgataatccttctaatttcgtcatcgcggccgataacaggttcaattttattttcttttgctaattttgttaaatttcttgcgtatttttcaagattttcgagtttttgtttcatttttttcctttttaattttttatttttcttaacaaaataaattataacatattttttggcacttaaaagtaaagagtgccaattttttttcttaaatgaaaaaatactttaatttaaaggataatttaaattttttacctttaaattaaacgaaaaaatgatataattgattaatatttattatgaaaaaaattattattggaaattgaaaaatgaataaaaccgtaagtgaaacacgtgattttattcaaaaatttgacattttctatcaggaaaatgtgggcaaaatcaaagaagatttagattttgcaatagctccaagttttatatctttatcactaatttctaagtccttgactaaaaaattagaaattgctgctcaaaatcttagtcagtttgattcaggagcctttactggggaaatcagtggcaaaatgctgcaggatttagggacaaaatatgtaattattgggcattctgaaagaagagaaatttttaaagaaaaagatgaagaactaaaaaataaaattttacaagcacaaaaatatgatttaattcctgttttttgtgttggtgaaagtcttttagaatttgaagccggcctaactaaaaaagtgataatttcgcagataaatgctataaaatcagttctaaattttcaaaaggcaattattgcatatgaaccaatttgggccattggaactggcaaaacagcaacggctgcaatagcagaaaaagtttgtggactgattaaggaaaattttgggaaaaatacaatggtaatttatggaggctctgttaattctaagaatattaacgagttagtatcccagaaaagcatcgatggcgcccttgtaggtggagcctctcttgatccagaagaatttggaaaaattttagttaatagttaattttttacttttttattgtataatttagaaagatttgatttattacttggttttaatagttttcgcggattaatactaggttttaaatttttaattaaatttttgaaaggatttcaaaatgatatcaaaagcgagaaaacaggaaattatcttaaaatttgggaaaaatccaaaaaatacaggaaatacaagcgttcagattgcacttttaactgaggatatcgaaagattaaaactccattttttaaaaaataagaaggataagcattcaatgcgcggttttattgccaaagttaataaaagaaaaaaacttttaaattatttaagaatcaatagttttgatacatataaggaaacaattgaagccttaaatattagaaaataaattttttcttgttataaatttcaaaaaaatagtggtaaattttaaccactatttttttatttaatttaaaaaataagtttaattatttttatataaaacatctttaattttatatggtataattataatttgcacaagtcaattgcagatataattaaatataataatttttttataattgttatatttaacaaatttatatttgaggaaagtccgcgctagcactacctgagatggtagtagtgttcatgttggatctaataaatccaagctttagacgaccagtgccacagagacgagtttatttattaatttgtttatattaaaaaatagtttagaatttttaaattaataaataaggtgaaacgcggtaaactccatgagctagaaacctaaattttggtaagggagcccaatttcgggaaacaaactttaattgggaagttctattataatatttttataaagaacttagataaatgattgattaatacagaacgcggcttattagtgcaaaaaaaacagcgaatctagacgctgttttttatttttgaaaaatataaactatttttttgtttaattcttatcaactatataagcatcaataagcgcttggcgaatttcttgattattaatgtttgatccaaatactaaatttttatcatttgacatcataaacgctttgaatgttactggtgccttttgagtttttggatcgctatcagtagctccaatttgtaattcatttaaaatatcagtaaaacttgggattgggcttacaccttctttggctttgtctgcttttttataatgtaaacttctatgcattctactttctataatttgtttatgattttttcctgcttgagaagaaaatactgaaacagaaagtcgatcattgttttctacaacctctaaaagaatttttgtattcgccttgataaattcagtattttttttgtttttatacttgttaaaatcaattaaaagtgagggtgtgtccaaaaaactactattattttggtcctgttttcatccaaaaataaatttgataaaaccgtcgactagatcaacaatatcagtaataaaattattttcattccttccaggatattctagtcctaattgataaccagtttcatccttgaccttgtatttgttaagaattattccatttccttttccatcggatattagatgatgatttttgaaatctgttatattattaacttgaagcgctagtcaaaacactccaatatcatcctttttattagtcttttgtgaagtagtagaagaagagttcgttgttgggcttaatttcaaaggtttccttagctctaaaccttgatcagtttgaattgcatcttctgatttaaatattaatttattatcacttaaatcttttaggataaattcttttttatcttttccttgatcttgataattaattgttccatctagaaatacatcgggattgaatttcttaattatatcataggcagatttattagaattaataatattattaagactaattttggactgggccaaaattagattttgattagttttatcaactaatttaaaatcaaaaaatagcttatttcctaaagttgagatctcatattcgctttttgtattttcaagtttataaatattagcgaaattaaaagctgttcaaatgcttgtcccaaatttttcattttctaaggttaaattcgtactgcttgtggaattagaattcgaattttgactagtttgaggggatgaagtggaaactggttgtgtttgctgactttgactttgtcccttagcttcttctgcaaaagtgcttaccttgactgtttttgctgaattttctgttgttttagctagtgaaacctctggttttttcggttgtgtggggctatttttttctgttttttgagtatttgcctttgattttaagccctcaatcacagtttttactcttgttttactttttcctggtcttggtcaactaaatattttcccgtatttaataaataaatgcttttaagaacttcttcacttggattttccaaattagtcactgtttttgctagttcaaaaagtcgatcaactcgctgttttatttcatttgaggataaagtttttgcatcttgatcttcaggcattgaaaattctttaactgcttttatcgttccaaacatttgggcaacagcggcttggtatttattaaaatcaacttttagatcaacaaaaactggaagatcctggatgataaattttttatcaatagcttttcgttttaaagaagcagtaatttcaaagcgaattttttgattttcagctagttttttcttatcaacaacagaaatctgacttggatctaaaagtttgggaataatacttaaatagacagttccgattttggtattaagaaaaaaatttgactcacttaaatcaaaaagatctttaaattctttactttttgttaaaatttgggatgtatttacttttgaattcggagatccatatcaataatcagagaggctaattttatcttttactagtgccatttgcaaatcatctttggtttttaatttgccttgaagatttgtttcaagtcaggattttagaattttagaaatttcctgatttgaaatcgcgccgcgaacttcaagatttaaattcatagtttttttagttgaaatttgcactaaattaagtccaagaactaattttccatctttatttaacaaagttaataatttttttcgatccaaaactgggtctaattgataatctggacctaaaaatacgggttctcctaaggaattataaagtgaaagactcgcttttgatgcaaccaaggctctttcaagtcgtgaaaatcaattacttcctctttcattttcaaaattttgggcaagcaaaatttggaattccatcaaagttagatttgcccttgaaagatcgacaaaagacttgcttgaatcaatttggctaaaatcaaaattagttctagcttgttctgtatttccaaagcctttaagtacaatttgttttgaataagttatttgatccttatcagattttgcataaataataacatttttaattgaattttgatcaactactgcattttcaagatcaaaacttactaaataatcattgtttattagttcacttaaatcaaaagcagaaacaagattataacgataaagatcacttttggcagcagttaaaactgtttttgccgatcattttttaaaattatctttaattttaagatttaaaacaattgaatcaaatttttcctgactaattttagctttttctgttacttttagctgacttgggatctgatttagataagaataatatgatttattataagaattaattccgacaactataccaacagcggctgataaactaagactaattccggcaattgttgttattaatcaaaaaggttttttaagtaattttgctaacttcataggataaatacctccgggttttatttagattgaggagattatgctggtaatttactttaaaaagtttttttattgagctcgaaaaagggaaaaatttgcttgtcttatatatttaaattataaccttttttttattttttttgtattttttgttaaaaatttagattacaagcttttttataggtatataaattttttagacttaaaaaatttatgaaaaattatctaaaaaatattatttttggaaattataccaaattttattaatctgagaaattttatcaaatttttcagctttttggctaattgcttttgaagttaaaagcgcagtaaaaaatgaacaatactcagttgcataaattttattaccttggaatttattaagcccgacaatcattgtatatttttcattatttcaaactaaacctctaaaaaaataaagtttttttgtatataaaacttcttgaagcactagtgtttgtttataatttccttctagaaaaccaagataatattcccatactaacaattttgctttaatttgatttaataaactacggtttttttgcaaatctcatttttgaaaactgatgaatttttgctgtaattttccattataaattaaagtaagaattttttttgtcggtcagttttttaagaatggtatttttcttagacctatcccgtgcggaaaatcaagcaaattaggtctaattgcaaatattttttcagtttgactataagcaattgcaattgtatataaattctgaacaacattttcgtatctttgaagatttagctcaattttattaattcatagactaatcttgttcatctgctattataaaataaaaaaatcctttaataatcagtttatcaaatttaaggaaaaattaggcaaaggcaataaaaaaggaaaaattagaaacttttagctaatttttcctaaatttagtaattttgctctgaaaagaatataataaaatatctaatttaaataaaaaatctccaaattaatatttggagattaaatttgctatatttttatagatttttattaattattgttttatataattactaataaaagcattatttattaaacgcattttttctgtatcgtttgtaaatgattttttatcaaataatgctattgcttttatacttacagctggcggttgggtttttgggttttgaggttgactatctccaattttattaggactaaataaagaatataataatgaaccttgaactgtataaccttgagagggaaatgattttctattttttattttaacaatcttttctttgttattatcttgtgctgaaggtagtgaataaagctctgttacaatatctttttttgacttataaactactaataaataatcagcgttttgacggagaataatttttttctttgatcgaggatcaattgaaccacttgcatctaatatcgtatcagcagcctgaaattgtttatccctgaagtcatcaggctcatatgaatcaattctaatctcaaaagcgtttggttcttccttatcttgatatctctgaatgaagacacctttatcatttttatctcttattagataatgaggtttataatcatttttattgatattattaacggtaaatgcaatataaattaatcctgatctaagtcctggtagaggttttttttgctctgcttgtgtttgtaattctagtttgagtacattttcttgtggattggatccagtttctggtttataaacaaagccattacccattaaatctcttaacgattttaaagtataatctttttttgcttgctttttataatcaggttgttctcctattgttgcatcaaggaaaagatctgggctaaattgtttaatctcatcataggcagacttatcagaattaattagaccaccaagactaattttagatccttgataaataattgctcgatctgcttttgatacaagcataaagtcaaaaactaatttatcatcctctgttgagattgtatattgcccttgggtgttttcaaaattataaatttgcgctgtatttagtaactttcaaattgtatgtccaaatttttcttctaaagctattgaactttgtccactgttttggctaagacttgattttggactctgacttgtagaagaagcttggacctgaccgttcttagttgtttgttcaggttggtttttcatactaattatatcagaaaaagcacttactgaaacttttttttctgtccctgttgatgtcttagtagttccactagaagttgcagatgtagttggtttttgaataggactaggcacttttggagccaaattcttggtgtcagctttcattcgggcttgttctattatttttttaagattagttttttcttgctggatctcatcatcaaaaagatatttccctgtatttaataaatagacagcacgaacaacttcatcacttggttcggataaattactaacttttgcggcaagatttgctaatttatcaattgtttctttgatttctttggttgataacttggctctatcttgatattcttgcattttaaattctttggttgtatttgttgaattaaaaatttgacttaaggctatttcgtatttattagaatcaaggcttaggtcaactaaaactggaatatcactgagaacatcttgttgatcgagtgcttttctttttaaggtggttagaacttcaaaacggatttttttatcagctagaagttttttcttatcttcttgactaatttttgcaggttctaaaagttggggcttaattattacataaaaagttccaaattttgtatcctgtcagaattttgctgacctaaaaccaaaaagatcctttaattccttagctttttgttttacttgatcagttttagttctttgctgtggacttccgtataaatactcagaaaaactggttctatcatggaaaagagcattttttagttcaagatttaggctaagattttggtctaaatttgattcaaataaagtttttaactcactagtaaattcttgatttgttaataatggacggatttctagtgttaaattaattttcttttggctctctttttcaactaaattaagttctaaatacaatttcttatttttttctagtaaatttaattctttttttgaattcaaaactggttctaagcgataattttcatctaaaaatactggttgccctaaagaattataaagtgaaagacttgcttttgaggaaatcaaagcatttgccaatcttgtaaaagaatttgcatttcttatttgtcgataattttcgctaagaattctttgaaattcagaaaaagaataatcaaatttataaagattaacaaaggattttctttgatcaatttggaatttaacaagatcgcctgcagcttcatcatcttgagcaaaacctttaagttcaatttgttttgaataagttatttgatctttttcagattttgcaaaaactagcacatttttaattgaattttgatcaactactgcattttctaaatcaaaactaatttgatagttgttagtttctaaacttgaaaattcaaaagcccgaactaagtcataccggtataaatcattttttaccgctgataaagctgtttttgctgatattttcttaaaattatccctaatttttaaatttgagactattttatcaaaatcttgttgggatatttttgttgttttagtagtttttagctgacttggattttcatttagataagaataatatgatttattataagaattaattccgacaactataccaacagcggctgataaactaaggctaattccggcaattgttgttattaatcaaaaaggttttttaagtaattttgctaacttcataggataaatacctccgggttttatttggcttgtttattttctttttttctaatgagaacgcgaacataaagtgttgatttttttgctgccggggaactaacgggtttagccgcaactggttttgtagtttcaggctttgctgcttctgtttttggagtttcaggttttggagtttgttctactaatgcaaagtcaaggaatttatatcctccagaaaatgcttctataattttttcaacctcagcagagtagttttttccttttgatttaagggatttttctacttttgtacctaattcttgaatatattctgttagcttattgctattttcctctggttttttagattgattaggagcgccttcggcttttttaccttgatttggagttccttcacttttttgggttttgggaaaagttaaagaagaaaatgcagactcatctaatcttcattctttaaattcgctttggagttctaataccgttttatctaattctttgataattttattttcttgataatctttatcggtctgaagttctaaaaatactttaatttccggtgtttttaactccgattttgctccatcacgataagaaagtttaaattcaaatgaaattggaagataatttccttctaatgaagacgaagaaactgaacttgttgttgagcttaaaggttttgcagcttctggtttagccgccacgggtttagctgtttctgattttggcggaactggcgccggtgaactaattttatctgttaattccttaacttttttatcaatttcagcttttttgccctctttttcttgatctccttttttcggcacaaacgaatatttaagattatcatctaattttgctcacggagcaaaattattaaattgggcagcctttaggaaaaaggcttttaataaatcaccaaaattttcaaagtcttccccttctaaaagctttttgtcaatatttctagttttaaagccggaagaatcaattaaagaatgtttttttaattctgcaaaaacttcagcatcagttttatttgctagtttatccttgatttcttttggcagaactaaagtagcataaaatccttgacccttttcattgcgatatagaccattaaaagtaagtttggttatttttctaaaattttctttaccttttttacccactaggaatttatactgtgttgcttcctcaaaaatgttttttgcatttctaaattttcagcgtgggaaattagctgtatttgtatgaagtccccattttttacctaattcataaagagtttctataactgttagccgatcttttgttagtaaatcctgataaaaactagcaacttgatgcccatctaggaaaaaatcacgtgataaaatttcagcaattccgacttcggatactgccgctttttcattttcccttaaggctttaatgttttcaagttttggctgtactaaatttcctgttcaagaatcaagtaaagactgataaggattaaattgataattataattagtttcaagtactttatgaattgcttctggtttgttttctttaaaaagtgcatcgacttcaactttagcaattaaaagaggaccatttatcggttcacccccaaaatcaactaaatcttgattttccttacctttttcaaaaaatggtaaatattttgttttataaatttcttgatttatttttggaagttgattattgagcccttggtcaaatccggttagtttaaaaattccatcttttcgagcaatgatattctctggtaaattagttgaagttttgaaaaaactttcatcaacttttagacgaaaaggaattaaaattgttgatttatcagttttatcaagacttgccctttttacatctagataatattgaagactttcagaatttcccttgccagaaaaaattgaatctaacttgccaaaatcaaatttaattttattttttaatattttattaattgattctttggcttgatcagaacgaagatcgttattatcaaaaaaaccagacctaattgtactaagaatttcataggccgaagtttttaaaccttgctcattaaaatcagttttggtaatatcttttaattttaagttggctaaaaactgattaaaatctaaaaagtaggaggaattgtcttgtttttgtagtttaattgatgaaactattgggcgaaaattaaaatcttgaccaattaaatcacgagcactttgactaagatctgcttctaaaaatagaaatggaatttggttctgaacgctgacatattgattagttgcctgtgatctgcgaagactaaattcgaaaatatgcccagaatttccgggtagtttattttctgaagattcatttagctttgttattaaattatcaagtgaaggaaaataaatagcaagttttttgactaattcttcggaatttcgtgcctgatttagatcttcttgaaaatcaagtacgcgaaaacttgccggatttttataagaggatgtcggttttgttaactttgctaaatcatcggcaaagtttgtagattttagggatagatttcctacttgctgatttaatttatcagtgattttcttaagtgaaaaattaaattcggcaactaaaagatttgactgctttaaaaaagcgacactttcttcttgataaatatcagattttgctatatccccgtttgcaaatttttgtcataattgaaatttgactttaaaattttgattgacatcatcagggataatttcaagaatatgaaaggaaattccggcatttttatattctggatcttcaaggttaattttttctaactgatcaccgtttttagaaaaaaaggaaaaggattttagaaccttttcgctatttttgatttggttcttggaatctaaaaggtgatttttgattgttcaatagtcagaattagcaaaaaaagcatccggactaaaggataaagttgaaacttttgtagcaaaatcatttacaactttccgtggatgctctgatctgtattttgccaagctgctaagtccgacagttagaccaaaaactccaagaccaataatagacccaaccaaaccaattttaaaagttttcgattttgtcaatttactcatatttaacctctttttttggtggtatttttaaataattttttagttttttgttttttgctttttttatatataatataaattaaataaaattgttaaatttttattatttaattttcttattttttatttaaaaaactaaaaaattattcaagctgtacaaacaaaattataccttttttttttttttttttttgcaacaaaaaaaacaaaaaaaacaaaaaaatgcccattttaaggcacttttttcaaaaaagtttaaaaatttaaactagtagatctagatatcaacttttgcatattgcgcattttcttcaatgaaaattttgcgcattgttacgtctgttcccattaacgaatcaaaaacctgggcgactacttcaagatcatgaatttgaacttgatacattcttctagtctggggatccattgttgtctctcaaagttgttccggattcatttcgcctaaacctttatatctttggatagtaaatttggaattttcctttaaaatttctgttaaatatttttctttttctttttcattataggcataaaaaattttttttccttgacttattttatataaaggcgggatcgcaatataaacaaagccaaattcaattagctttttaaaataacggaacaaaaatgttaataaaagtgaacgaatatgcgacccatctgagtcagcatccgtcataataattattttttgatagcggattttactaatatcaaattcaggaccaactcctgttccaaaagcggtgatcatcgatagaatttcttcatttttaagtactttttcaagctgaaaccgttgggaattaataacttttccccgcaaaggtaaaatagcctgaaaatgtcggtcacgccccatttttgcactgcccccggctgaattcccctcaacaatataaagttcggcgatctcggaattttttgttccacaatctgcaagttttcctggaagagtcccaatatcaaaagcagatttacgttttattgcctcacgggcagattttgctgctctggctgctttttgtgcaagcagatttcgggcgataattttcttggcatcctcaggattttcggctagatatctttgaaaaacctcgctaaaagctttatttacaaattgacgaacctctttgttgtttaattttgcctttgtttgaccttcaaaaattgggttagtatgtttaattgaaacgattgcaattaggccatcttttatatcttgtttgacaaatttatcagtttcggatttgataaatttgttactaagtgcataattatttagaatacgcaaaaggccatcacaaagcccattttcgtgacttccgccttcagggttatgaatattgtttgtataacttttaatttgactatgatcttcttggacataattaagggcaaattcaaccttaattgtatcctgattatgctcatattgattctcgctataaatgattgtattagttaatttcttaaaatttttacttaattcttcgacataatcagaaattccgccctcaaaacagaaagtttgggaaaaatcactccgtttatcaattagttcaaattggattctacgtgttaaataggctgtatttttaagacggttaaaaattgtaagtaattgaaaactgtttttttcaagaatctcaaaatcggggctaaaaataattttagtcccactttgggaactatcaagattagaaattacacttaggtctgctgttttttggccgccgttaatgaatttttggtatcaaagtttgccatcccttttaataaaaacctctaattccttggataaagcattaacaaccgaggccccaactccatgaagaccacctgaaaccttataggatttaccatcgaattttccaccggcatgtaaaactgtaaatacaacctcagcggctgaaatctcatattttgggtgaattccagtcggaatgccgcgaccgtcatcctcgatactgattttgaaatcatccaaaattgtaactttaattttggatgcaaaacctgcaagagcctcatcaactgcattatcaacaatttctcaaaccaaatgatgcaactcgtttattccggtcccgccgatatacattcccgggcgtttgcgaactgcttctaaaccttctaagacaactatattttcggcttgataatcttttgacattagcttctccagtatttataaattaattattataccacaaaattccaaaaagccaggtggtttttttatataaaggaataaaaatgctttaaatttaaagtgttttttctttttggaattttcaattttttaatatcttggcttagcctcatgaatttttttctttaaaattcaagaagaaaagccattaaaacctactgttttttctaaaattttttttagaaaattagaaaaaatttagaaaaagaaactaaattattgattttttttaattattgattttttaataaaaattaagagaataaaaggcttaaaaattaaaaaaacctttaaatttaaagatttttttaattttgttgagctaaaagttttaacttcgcatttgctttttttgccgcttttgaagttttaagtcttcttagttcacgtcttttggccatttttaattttactatttttcgcattttaatcctttaattttgattgattttattaatttcaagcactaagtcgtttgtttttctaacaggttttgatactactttcgcaatatcaaaagtttggattttaccatctaaataactaattgcaagacctgatttatcttgattaattaattccatagctttcattgccatcttggctgctaaaattcggtcaaaagctgaaggcctgccgccgcgctgggtatgtccaacttctaaagagcgagtggaaatttttgttaactcctcaattttagccgcaaactcttttaggtttggtaaaatattctctgtaattgttactatcacgcttggtttgccttttgcaaactgttctaaaactttttgacttacctcttcaggggttaaaatatttgtattagtaattaaaatttcgcttccagttgccattgccgaatataaagctaaatcttgacaatgtctccccataacttcaactacaaaacaacgacgatgagaattcgccgtatcccttaatttatcaatagtttcaactatcgtattcaaagcagtatcaaatccaattgtataatcggtaaactggatatcattatcaatggttcctggtaaagcgattacttttattccttttaaatgtaatttataaccgccattataggttccatcgccaccaactaccacaagcgaactaatcccaatttcacttaaaatttcaacggctttattttgaacttcctcttttttaaattcaggaaagcgacttgatcctatggcagttccgccaaaactagaaattccattataaggaaaattttttgctggcaatatttttcttgcgattattccagaatagccatcaaaaattaaatatggctcaaaacctaaactaagtgctgattttgccaaaaaacttattgcagaattcatcccaggcgcatcgccgcctgaagttaatataccgattttttttgacattttaccttaaatagaattccttttttagatatataaataaaataggacaaaaaatttgaaatggtacgccctagaggatttgaacctctgacccaatgattaaaagtcatttgctctacctgctgagctaagggcgcatttggtgctcgaaactggactcgaaccagcacgggattactcccaaaggattttaagtcctttgtgtctaccattccaccactcgagctgctaataattttctgtttaggaattataccataaactgaaaataaaagcaaaaatttattttttaattttaattatgtatgactacaaaaaaattataacataaattatttttttttctaaaatttttaataatttaataaaaaattagtaaattaagatgtattttactaatttttagttaaaaattaaaaaatttttaaattatagtaaagtgaaatgaaaatgaaaatttgaatttttttaaagttattttttttcctacctgctttttttctaagtagttgctttaaaattgactttaatcttttaaattctggttataaaaaaaaattaaattccacttcaaaattaggagaaacctttatttttgattctgttatgaaaggtctttcaaaaaattttaaaaaaccgcagacaaaatacaacggatttttaacaaaagaagttattcaaaatttaaaaattggacaaataaaaggtgaaactaatgaaaaaccagatgaatattttggtcttgaggaggtcatagtaaaattttttaatacacttgaaaataaggataattttgagaaaaaagaacaactttttttattattaaaacaaaaaattgagactacagatttcaaacttaatttagaaatcaaagatgataaggaatatgttagccaaaaggatgccaaaattaaaatagaagatccaatttttaatgatcaatccgatagggatttttatattgaacaaaaagaattattcgaatctgataaagatttgaataaatttcttgaaaaaaagaaaaaatacctttttcttgaggaaaaattcataaatgaagaaaaacagtggaatcctgtaattaaattaatttttcagttaaatatggcgcgttttcacctagattttattcaggcaacccaaaatatgtctaaaaacattatagtttcaataattgattatattataaattttgaaaaaactaaaaagcaagaagaagaaaaacaagccgaaattaatatacttttaagagaaaaagagcgaatagaacttaaaattaaagaaaaaacctcagaaaaaagtaataaaaatgatgaaataactagaaaaattgaagaaataagtcaaaaaatcattaatttaaatggcatacttgaacaattaaagcaaaaaaacttacaaattttaaagaataatgtcagaaaaatttgtgattttttgacaaatttttttgacccgatttatcactattcaatgaaaagtgactatgttttccagaatgaatctgatctaagagttaataatcaacttgcttttagcaaattttttagtttttttacaaaaaatttaaaagaaaaactaaccaaatacggtatcgaatctccctttgcaattttagaagaagaaaaaacaaaactaatcgaaaaatattttctacccttgatttaaatttaaaaaaattacattaatttaaagtgtttttttaaaatatggtataattaatcttccaatttgctcaaagggggagataagatggaaccagcattagcaaaaaaaaacaagtcacagaaaatcaccttttttggcgctcttttaatcgtgcttggcgcaagtattggtgctggaattttctttaaatcaaagtctgttttggaaaattcaggttataatttggctcttgcaatcggaaactgaattattgcttgtttttcaattgttgcaatggccattgctcttgttgaaatttcatcagcaacaaaaaaatctaatttatctattattatttgaaataaagtctttaattctcaagctttttttcaaatttcaaaaaatttcattatttatctttatctaccatttacttattttgtcctccctgtttattttatgcaaattttccaggacgcaattgcggcttttcgccttgattcaagcgggcaatgaaatatgaattcagactgaattattgtccttgctgtttcaattttgataacaatttatttttttatcattggattaaatacaaaaattgcagaatttcacaataaattatttctttttgcgaaatttttaccaattttggtaacaataattgttggttttgtatttttttttcaagggggatcaagtagattatccaataattttgattttttaccgatagaaaaaataaaaacagaaggagcatcaattgcctctagtttgccaggagttggtgttttaatttcgatgtcaggaattttcttttcatatgaaggattttttactgctgctggtttacaatcagaaatgaaggaaccaaaaaaaacaccaattgctattttattaggtattgcaattgcaacgataatttacctttttattgcagttgcaacttcaattgttggggatggatcaatttcatcttttattcaaattgcaaaaaacgaactaaattggtcaggtttaactattaaattaattttaggaacaacttttttgctaattggagtcagtttactcggaattattaatgtttttactttatgaggtccacgtgcccttgaagaattaattatgagagatgaattttccttactaaaaaaatggaaaaaccgtataaatttaaataaacctaaggtttctacagtttttttatgtattttttctgttatttgcttaattatttttacattgattggtgtttttgcttttgatgatcaaagttatggtaattatggtgaaaaattaaataatttatattcatttgcagatattactggaaattgggcggctttaattagttttctattaatcgccgcggcaatttatggttgcattcgaaaccgaaaaacgcaaaaaatagccgttcagaagcagcgttattttctcttttttggctatatttcagtaatttttattactatagtattaatttttgcaatttttgccccaattatagatttgattttaatttttagctataaacctccaattcccgaatttagtcaaattctaaaaacgcgaataactatcgttatcgtgctttttttgtttatatttgtcccggttttgccggttatttgaaattgatggcaaaaaaaattaaaaattttcaacaaaagacaaaaaaatagtttataatataagaaagttatgcaaattaacttagaaaaatatattcgaaccgtcgaagatttccctaaaaaaggaattagttttaaggacatttcaccattacttgcggatggaaaagcactcaattatacaattgtcgagatggcctcacttgctaaagatgttgatataattgttgggcctgatgcaagaggttttttatttggcacaccaacagccgcttttctttcaaaaccatttataatgatacgaaaagctggtaaattaccaggcgaagttgaagaatttgcctatgaattagaatatggttcagcaattcttgaagttcaagttgatatgattaaacccggacaaaaagtagcgattattgatgatgtgctagcaactggaggaactgtaaaagcaatcaccaaaatgatcgaaagagctggagcaattgttgataaaatcatttttttaattgaacttgaacaattgcaaggtcgtaaaaagctcgaaaattacgatgttatttccctaataaaaataagttaaaaaattttaattaagtttaaatttttaaagttttgactttgtttataagtcaaaactttttttatataaataataaaaactttaaggtataatttaaatgtaagtttatttttgaactcgagtgaaattttttcttatattttctcgagttttataaaaactacgaacaaaatataaaaaaggagatatatggacaaatttcgctatgtaaagcctggtcaaattatggcaaaagatgaagaaatgattcgctttcttgatattgatggtaatcttttatcttcaactgtttttggaccaatcgacgaaacaaatgatattcgcttatcaaaacaggaaatcaaaaaagcttatgaatttatggttttatctcgccaacaagatacgtatatgacacaactacagcgacaaggtagaatgttgacttttgcccctaactttggtgaagaagctcttcaagtagcctcagggatggcgctaacaaaagatgactgatttgtcccagcttttcgttcaaatgcaacaatgttatatcttggcgtgccaatgatcttgcaaatgcaatattgaaacggtagcgaaaaaggtaatgtaattcccgaaaatgttaatgttttacctattaacattccgatcggaacgcagttttcccatgctgccggaattgcttatgcagcaaaactaacaggtaaaaaaatagtttcaatgagttttattggaaacggggggactgccgaaggcgagttttacgaggcgctaaatattgcaagtatttgaaaatgaccagttgttttttgcgtaaataacaatcaatgagcaatttcaaccccaaataaatatgaaaacggtgcctcaacaattgctgcaaaagcaatggcagccggaattcctggaattcgtgtagacggaaatgaccttttagcttcttatgaagtaatcaaggaagctgttgattatgctcgttctggaaacggtcctgttcttgttgagtttgtaacttgacgtcaaggtgttcatacctcttctgataatccacgaatttatcgtactgttgaagaggaaaaagaacacgaaaaatgagaaccaatgcaccggattgaaaaatatatgtttgaccgcggaattcttgattctgccgaaaaacaaaaaatttgagatgaagcgcttgcgattgtcaaagaaacttatgaaaaatctcttgttgggcttgagtcaacaattgatgaaattttcgatcatacctacaaggttttaccaccagaacttgaagaacaaaaacaagaagcgcttgaattttttaaaggagtaaaataatggcaaattcagataaaatcgctcttaataacatcggtgcagttacaaatgctcttgatttaatgatggaaaaggattctcgcgttgttctttggggcgaagatgccggatttgaaggtggggtttttcgagcaactgaaggtcttcaaaagaaatacgggattgaacgcgtctgagattcgccaattgctgaggcttcaatttgtggagttggagtcggagcagcaattgctggacttcgtccagtcgttgaaatgcagtttcaaggattttcctatcctgcatttcaacaactttttgttcatgcagctcgttatcgaaaccgttctcgcagtcggtttagtgttccgatggtaatgcgaatgccgatggctggtggtgttagggctcttgaacaccattccgaagcaattgaagcactttttgcacatattcctggactaaaagtggtgatgccttcaaccccttatgatacaaagggacttttaattgccgcaattaatgacccggatccagttgtatttcttgaaccaaaaaaaatctatcgtgctttcaaacaagaagttccagccggaatttacgaggttccaatcggaaaagcgaatgttataaaagaaggttcagatcttactctggtaacttatggggcacaagttcatgaagcaattgccgcaattcaacaacttccaaatacaaagggacttgaagaagttgatgttgaactaattgatctaagaactattaaaccattggatactgaaacaattattgaatctgttaaaaaaactggaagaattttaattgttcatgaagcagttaaatccttttcggtttcagctgaaattatttcccgtgtaaatgaaaaagcattcgagtatctcgaatctgcacctgctcgacttaccggttatgatattactgttccacttgcaaaaggtgagaatttccattcaataacaaaagaaaaaattattgacaaaattcgcaaaattatggaatcataatttaatttcgtttaaaaacttaataaaaacattcagaattcaattttttaattctgaatgtttttttttttttttttttttttaagatgaagaataaataacggactctaaaaagagaaatggggcggatgacggggatcgaacccgcgagtgtcgggaccacaacccgatgcgttaaccacttcgccacatccaccaaatatggaaaccttatttattataccatattttttttaatttgataatcaaattgtaaaaaaaattaaaaaacactttaatttgaaggggtttttactaattaaatatgcaaaaaacgaataattcttattaaatattaagttgaaatttttgattttcaataaaaaaaaattaaatttttattattttttggttcgttgtttagttaagaacttactaaatcattgaaatttctaaaaatttcaatgatttttatgttgtattcacatttttgtacctgaaaattaccagcttaaatttgtctttttttttttttttttttttgatttttcttaccttgatatgtatgttaacaaataaaaaatactttaaattaaagtattttttaaattaaagttaattaagccacaaaaatttataacaaaaaactattttgggtaatatttactaatattttggatatatttagtattcaacaaacaatttttcattacttttgttaaatataccataatctttaatctaattaatttttataaatctttgacttttaaaaataaaaaaaataataaacaatctaaaaatattattgtataattataatattaaatttataaatagaggttccataaaaaatgaaaagtttggaattaataaatattttaagcttgggaaatgttgttgtatcacaaccttatgaaaatcaaaatttaatgcttaaaaattattttctcaaagctgaagcttattttttagatcaaattcaagatgaagaaacaagaaatttatgaataaaagagtttgtttattctatagattctttagatagttttaattataaagaattaaattatatctttaaaaataaaatttttaaagatcaagatcaaaaaaatgctattttccaaaaaatcagagaaaatagtaaaatttataaaacatttcaagaacaaaaaaataaaaaatctcgtagaggaaaaagaagtttattcaccgaatatcaacgtttaactattcaagattggattgatataatccaaacagctatcgatgataaaaagggagacgcaagacaagctagaagtgatggaacctcttatataacctctggaatttcaactattacctcaacttttgttggcggattatccagcccatttttgtttgctgcatccacaatgggactttatggaactatagtgggtgggggacaactaatagctggaggtgtttttggtggttattattataataaaaattgatataccgctgaaaaattaagtaaaaagctgacggaattaaaaagaatttttagaatcattaaaacctcaaataatacaaatttagaagaaaaattaagaaaagatataaaacaaattatagataaaattaatgaattaaccggagatatgatagatttcgatgattttgacaacgaaaaaatcatcgaaaatggatactaaatttgcaaatgaaatctgttagtttattttttcgggtaatatttctaagtagtacaccatttaaaatcattctaatagtgtttctttcgggatcaatagggtgtgtgtttggtatttcattttttggtggatcatttgaaaaaggcgaacttttagagcttcgaatcccaatatatgcaataattgtgtgcagtttaatttatattttgataaaagcttttctttttcttaaaagatacaaaaaagaagctttatttttaacaaataaggaatttgaagaaaaatattataatttaacaataaaaccaataatttgaccagtttgattgcaccgttatgatgttcttattcgtgaaattgagcaaaatccggataaaattgaatttagtaaggaaaagaaagagtttttattcaaaattcactatagaatttatatatatgaatttatacttatttttttaggtttaattcttattattttactatcgattatagttgaaatgattccgaatataatcaaaaaaacgttatttcaatattatgataaccaaaaaaaccagactaataattcactaaaaggactgccacttttacttatttttataggatatactttttttacattcttaaattttgtgcttacaagaaattttctaactcatatttcttgtagtcttattaaaagtcaaattaagcatgtttataactcatacaaaaaaacacccgccatattttttatgccaaaacccaaaatttaaattttttaatcactaaatttttaacctcaaaaataaaaaagtactataaatttatagtacttttttaaattcagagactaaattagcttctattctttaccatcatcaggacttagataattaactttgatgttttcaacatcaaatgcaaattggaaagagttactatcgcctgcacgaattcggttaataattcagtaagtatcaacctccataattgggataattgggacaaattcgcggataattttttcaaaaataactataaaatcaaaaaccttattttgggtccaaccctcttttttctcatgttcactaaaaagaccattaaaaaaagcatcaatccgagcattatattgatcaagactttcttcatattcaggtattagaattggcttttgattaatatctagtgctttgtcttttaaatttttatttagaaaaacctctttaaaaatcggatttttttgattatctagcctaatttttcgtataattaactcctcaaattttgcaagataaataggagaaatttcatctgattaaaaatgtttttcaaattaaagttaattagaccataaaaatttataaaaacaaaaactattttgaatatatttagttttgacaaacaatttttcataacttttgttaaatatactataatttttaatttaattaatttttataaatctttgacttttaaaaataaaaaaatgataaacaatctaaaaatattattgtataattataatattaaatctataaatagagatacggtaaaaaatgaaaaatttggaactaataaatattttaagtttggggagtgttgttgtttcccaagcttatgaaaatcaagatttaagacttaaaaattcttttcttaaagctgaaacctattttttagaccaaattcaagatgaagaaaagaaaaatctatgaataaaagaatttgggtattctattgattctttagatagttttaattataaagaattaaattatatctttaaaaataaaatttttaaagatcaagatcaaaaaaatgctattatccaaaaaatcagagaaaatagtaaaatttataaaacatttcaagaacaaaaaaataaagaatctcgtagaggaaaaagaagtttattcaccgaatatcaacgtttaactattcaagattggattgatagggttcaaatgtttataaacaacaccaacaatagatcaaatacatctgaatcgatagctggtggtatgggtgctgcggctggaagttcgctggttacacttatatctacacttagttctctcactggtcctataggatgggttgctggtttaatatcaggcgcattaattattggattttcaggtttgagtggacattatattgggcaatcacttggtgaaagagacaaagctaatgacgtcgcaattttacttgacgaattaaaaaaaattttaagaattgcattaacatcgaatgataaaagagaggaggggaatttaagtcaacgacttaaaaaagttattgatgaaattaataaacgagctaattatataattgattttaatgatttttaccctcaatttcgtagcattaatactgtattaatacaagatataggaaaaaatgaaagcaataagtctcttcttttattctagcgttatccgatcaggcgggttaaaggtttcagcttttattttaattattggaatgttttcttttaatttatttaatatttttgcttcttttagccaaaatgatttattgtgaattagatgtatattttactttttcttaacctctccagtactttatattgttactaaatattttcgatttatcaaaaaatataaaagtgaagctttagtcttatccgatcaagaatttactgaaaaatattataaacttgtaacaaaacctttaagatacacgcgttttaatgcgataattcgggatttagaagaatttaatgaaacaattgaggatgaaactcaaaaaaaacaaatcttatttagagctcactatcgaatttttattttagaagctttggtaattttaattggtttggttttgtttttgctttgaattagtttgactgaagctagtctaataaatttaagtgttcttccaaaggaatacgataaaaatcattcacttcgaggcgctttttcatctattattttttcttttttattattatttttaattatcattagcgtttttacaagaaattttttacattatatttcaagtaatcttcttagatattccattaaaactatttttgattactataaaaaatcaccgtgacgtttttttatgaaatagtaataatgaataatcaaaaaacactttaatataaaggataatttgtaattgcttttttcttctcctaaataaaaatattataaaaaataaaaactccaataattttggagttttttaaattcaatcgcttttttttaaaatttctaattttatgaacttaaattttaaacgtgacctcatttacgtaatgtttttttagtttttgctgatactttaagtcgaattttttttcctgaggctgtttttagtgttatttgttgtaaattaaggttaaatttcctttttgttgcatttagagcatgcgagcgattatttccacttaatggtccgcggtgagaaatttggtcttttcttgccatttttactcctaaaaatttaattttaaaatttgcgctgcctaaattagaagattatttaagcagattttgcaattgctaatttaacgatattttcgaaatcactttggtgatgaattgccatttcggctagcatttttcggttaatttcgatatttgattgcttaattttatgcattaattgcgaataagaaatcccttggttgcgcgctgctgcattaattcgactaatccataatttacgaaaatctcgttttcgctgttttcgatcacgaaaagcataagttcaggatttaactactgcctgttttgctgttttaaaaccaatcgatttatgccctcaatagccttttgctaattttaatcaacggcgacgacgctgacgtgttatacttccgcctttaactctcatttaaaatatcctttctttttatgtatttttcttaaaagtgttttttaaattaatttttttagtcttttaaaatcagaattattcattaaagttgattttcttgattgacgtttttgttttgttgttttactttgagcgagatgtgaacgataagcatggccatgtttaacttttcctgttcccgttacttttatccttttttttaatgctgattttgttttaaatttgattttagacattctcttcttcctcttttttttgtttttcgtattcgagtaattcttttagttgttttgctgaaatgaattttgggagttttttgcgatcacgttcaagatgcataactaaaaagtttccattttgtgaaatttctttactttttttagcaatatattttaactgatcataaaagatatcaagtgtttttctgccttgatcaaccctagtaatttcacgaccgcggaaacgaagggcaattttaacacgatcaccatcaagaataaattcacgagcttttttcgatttaactaatatatcctggaaatttatattaaaactaacgcgaatttcacgattattagtaaaagattgcttttctttttcttctttttttttcttttttatatcataacgaaatttaccatagtcaagaatttttgcaattggaactttttgaatttgattatctttagttttaacttccttaatcgaaattaaaactaaatcaagacctttggatttagctaactcaattgcttcttttgttgcgattttcccaattttttcattatcagttccaactaaaaaaatgttgggaaaaagtatattttcgttaatttggtggtcttgtaatggttttttctggaaagggggtctgtgattcaaaatttaagttttactccattttagatcgtttagtaaatttttttttaaaaaaatttactaaaaaacgaatttaattttaattttggacaaaaaaataataatttttgtttgtcaggtaaacccaagatcactaacatcttcaggtgagatattatctactttctgcaaataaaaatttgcatattatattatacaggaaaaacaaaaaaaatattaaaaaaataaaaaattaataaacaaattgtaccattttttcgttttctaccactaaaaatgtatcacctttttcaaccccaaagggttctaatacatttcttgctagactaaaatcatttttaattgctgtaaattcagaaattgagttaattgagacaaaaacggaggatgtaattccaaaaccattaattaatttttcattattaatcacgccaattacggctgtatttggtctaaattttgcaatttcccttaaaagttggccagttcgagataacactactgtgtattttatttctttttcataggctaaatgcgctaatttatgggctatttttgctcttagtccccttgaattttccgtaattactgccagttgctttgcataaaaaagtttgttataaaattctttttctgctcttttattaataactgccattacctgaactgactcgattgggaactgaccctgggcagattcaccagatagcattgtcgcatccgcgcctaattcagttgctcaatagacatcagttacttctgctcttgttggttgggatgatttctccattgaatcaagcatttgcgttgcaactacaacagttttaccggcaaaacgacatttgcgaataattcttttttgttgaaatggaacttcttcataaggcacttcaagacctagatcgccacgggcaatcataattccatccgataattcaataatttcatcaatattttcaagaccaagtcttgactcaattttggagataatctggatatgtccgccgccgttttgatctaaaagtgtgcgtaattcacggacattttcacctgaattaacaaaggatgcagctatataattaacattttcattaatcccgaaaagaatatcatcaatatctttttgggataaaaagggtaaggaaaatgctacaccgggtaaatttagtcgcttatttgactttaaaatatgtgaatttttagttctaactacaacttttccgggctcaatttcgattacaactgattgtaattttccatcatcaaataaaattttatcaccgatttttagatccttatcaatttgatgagaaacagtaattatttgggctgttccttgaaaattttgataagaatctgaatctgttaggacagttaaacgttggtttgcaaggattttttgggagccttctaaaattttgccaatgcgaatttcgggtccttttgtatctaacataattgaaattggaatcttaagttcattagaaagcttccgggcgctgtcaaatttttgtttttgctcttgataatttccatgggaaaaatttgcccgaattacactaaccccagatagtactaatttttttaggacctcataatcctgcgttgaagggccaattgttgcgattatttttgttctttttgaaatataatttttcatatcgttcatttttttgatggcaactttctcgtattttgtattttgaaatggtttaaaaagtgcaaattaattaataataattataactaaaattaagaaatttactaataaatttctactatttttttaaaaaaaacatttcctagagcatcaaattgcattctctgagtcattttagacttatttatgaagatctcatagtgttttttgccttgattttcgggaataatgaggttaattgtttctaaattttcccaattaaatgataacaaaatttgcataagagacaaatttttaatttcaagtttaaaactattatcaaatttatcaaaattatttaaaaaatcaaatttaaatttataaaaatcaaagatttcttcaccatttttagcactaaaactagcgaaaatatcgacctgttttggtgagttcccgacaaaggcatatgtattaacactaatattttcaaaatgaaattcaagtttttcaagcaaattatctgcaaaacaatcagaggcaatttctgaaattgtacttggaattataaggttttttattttattattagcaaaaacagagctatttaacttacgaatcccctttggaaattcgatttttttgaccatattggactcaaaagctgaatccaaaattgtttctagattagcgccaaaaacaattttttcaattttatttagcataaaagctgactcgccaatttttaatagcgagtcaggtaaaatcaatttttttatttccaaatccattcccgaaaaggcaaaatcagcaatttcttcaaaattcaaagaggataaatcaagaatttttcccgaaaaaaattcttggtttttaataattttaattgcgatttcacggttaagtagtaaaaactgcacttttttcctaattttttcctttttttaactaatttggtttttttacttaatattgactgaaaggaggttgagagatgaaaaaccaaccaaatcaaaatttagttaaattaagcgagaaagacaaaactgagaatggaggagctggagttcttgcaggaatttctggtcttgcaacagcaatttcaaaattaactcctgcaattctcggaattgcttcgatttatcgaacttttaccaccggttcaggtgagataaaagccgatggaaatactgttaaatgagatgattcaaaaatggctaaagcagaaactgaaaaagttggaaaacagccaatttactttatttattagttaagaaaaattactatttttcaggctattatttatatattaactcttgatgttctttttggccatattcaagaatgaaagcttcgattagatcaactgcggctttaatatctgataaactaattagaccataagttgaatggaggtaacgctggggaacagaaatacttactgttggggtcccataacctgaatattgtaatttttcagcatcagttccccctccttgtgaaacataacgataaatcgggatgtttctttccttggcaatcctaaaaagaatttcaactaaccgtgggtccattaaagcgcctccatcggcaatatcaattgccactcctgcacctagtttttgaacaccaggaattgcgccttcagtatcatgggatgctcctgtatcgattgcaaaagcaacatcagcattaatcatttttgcaaccatttttgccccacgggaaccaacttcttcttggacagttcctactaaaatcggattagattttaattccttattatataatcgatgtgctaattcatcaatgacaaccacgcctgcgcggttgtcaattgcttttgatgcaaaaaaatcttgattttgcatcaaaaaactaggattattaaaataaattcgattaccaatttcaacacctaaatcctgagcttcttttttagatctaaaaccaaaatcaaaaaaaagatcctttactagtaaggctttttcaattttagatctctccataatatgaattgaagtatgcccagcaaccccaaaaaactcctgacctgatgaactaattaacttaaatcttgcccctattaccgcatttcctcaaattccgccaattgatttaaccttgataaaacctttttcagtaatatctaaaacgataaaaccaacttcatccatatgcgcggcaatgactactttaggtccagaatttggattttttttctgcataattaaggaaccaaaaccatcacgagaatagacaagatcaagtttttctgttgatctttttaattcagcaacaacttcatcctcataacgcgacataccatcaatgtcgcaatattttttcattttttctaatattgacatttaaaaaatcctttcttttatgatataatttagaaaattatacacttttttttataaattccaattaatttctaatcgttttttttcttttaaaaaatcgttaattttgcggaaaaccatagaatttttaagcgatttggcgaaactaaaaggcgaaggatgtgaataggcaaaaactttttgcttttcaaggttaatatttttaactgctaattttgcttttttacccaataataaaaaaacaatatcaactttattttttacaataaagttgattaagttagaactaaaaacctcccatccaatatttttatgtgaattgggactggattttcgcacggttaaaacgtgattaagtaataaaacgccttgttttgcccagttttcaagattcccgttttcttttgaaaagtttgggtaggcattttttatctccaaaaataaatttcgaagtgaagggggcaaaatttttgttcttgttgaaaaagcaagtccatcggcttgaccttttttatgataaggatcctggccaataataacaatttttagagttgcaaaatttgttaattcaattgcgcgaaataaagcttttttatttggaaaaacttgatatttttcatattcttcatcgagtttttccattaatttttgaaaatatgcttttttagactcattataaaaaaagctttcaaacttagttttgattccattttcaaaaattatagcaagaaaaaaatttttttattgctttttttagagaaaatgctataattttagcgtttattcaaaccatctcataccaaaaaggtttaaatctgaaaattcagtacctttaggaaaaaaatcataaggagaagcttatgtttgcaattattaaaaccggtggtagacaacttaaagttgaaaaagatcaaacaatttttgtcgaaaaaatcgacaaaaacgagggagaaactataacttttactgatattttatttattaatggtaaaattggtactccttatgttgaaaatgccagtgttactggtattattgaaaaacaaggaaaagcaaaaaaaattgttgtctaccgccataatccaaaatctacccataaaagaaaattagggcaccgccaactatttacaaaagtaaaaatcacggaattgaaaggataatttaaaaaatggcaaagaccaaagcaggtggttcgaccaaaaatggccgtgattcggctgggcgaagattgggacaaaaaattggtgatggccaatttgctcttacaggttcaatcatttatcgccaaagaggaacgagaatttatccaggtaaaaatgttggaattggcaatgatgatagtttatttgcccttgttgatggaattgttaaattccaaaaaataagaaaacgcaaatacgcaacagtagtaatggctaaataattattgtctaaaaaattattttaaaagaagacacttttgtgtctttttttaattgtttaaaaatcagaaaaatactataaatcaaggaataatttagttaggtagtttaatttttaagtctaaaagcaaataaataattataattaataaaaattttaaattattttaaaataagaaaatttggtttttaaaaccaagtttttaattttcaaaaatttaaaaacttagaagttgctttataaaaaaacacttgtttttatagtgttttttttataaagtcactaaaaatttgattaaaatattcaggattttcgctataaattaaatgccctgttttaggaattatctctgtttgaacctttggaattagtgactcaaaatatgtttttgtctcttgctgtaatacaattccatctctttgacctaaaactaaaagtgttgggatttttattgattttagggcttgctcaatttggtccatcatattattttttagcagattttgtgctaatgaaacaatattaaaattattaaaatactcgtaattatagagactttttgctcattttaaatatttaggatctttatatttttctttgtcatattcataaattggcataaattcaagcatttcttctggtgtttttggaaaaaatttttcataaaaaaaatcttttaggggtaagtttgccttattcattggtgcaataaaaacaatttttactatcattttagggattcttttataaattaatgctgcaattgctgctcccatcgaatgtccgactaaaataacctcctttaaatttaattttttaataaaactaactgttaaatccgcataatattctaaataaagttggtcttcgctagctggtgttaaattatttccagggagagtaaaactataataatttagtgggatttttttacttattgagtcaattgtgcttgaaaatacgttatgatttgaattaaaaccatgacaaaaaacaatatgaattttgctaaagggattcctgttaattacaaaagggtaatttcaattatctaaaatgttattactttgtgaatttatcattgtatttccttgttttttcttaattttttttattttaattatataatattattctaatttttttagcattaaatttttccaaaaaaaattagaaaaaactttggaaaattcaaaaaatatggtataattaatatgccactaaaataataaccttgtaacctggtcaggatagaaatatagcagccatatcgagaagtgttgtgtttagtggtttttatatatatttaataaaaaaataggtaaaaatcactatggcttctcaagaaaataaggcattaaaaaagggctcctgtcattgccctagtcaaaaaaaacacaattttgccagatgcctaaaaaaaaggctaattacacgtgcagaacgtgaaatttttcaatttaatcaagataaaattaaccttaaaaacttttgaaaacgaaaaaccttatcaattacaatgatggctttttcatcaattctttttactttaggtgttgctttttttcttggatttgcaaaaacggtgccaactggcttatcggcaattcccgctttaattacaataattgttaattcacgttacaatgttgatgttagttgatcttttgcggtaatctatttcgcaattaatcttcctttattaatttttacgctagtaaaagtttcaaataaaagcttttcatatcttacttttttttgacttttttttcagattatctgaaatcaagtgttttcacttgatagtccaattcgggatttttttgttaaaaatattctaattaaggaaataaaagattcctgaactttattttattatacaattattggaggaattttatcaggctggtcgattggaattgcctgaaaatttggcggttcaggaggcggaactgattttataacttattttattgctttaaaataccgcaaaccaatcgaaaaaataatgtttagtatttcgatattttttggacttttttcacttgttttactatattttttccaacctgctcaagttaatggccaactttttgggcaaaagttttttgctctttttctctatctaatcgtatcttctacgattgtaggccgaatttatccaaaatatggtaaattacttttacaaatttatacaaacgaacccgaaaaaattattaagcattttaaatcaatcaaatactgacactcctataatatttgagaaggaatatccggctatacaagtcagaagcagtgacgtgtagagacaattatttttacaattgaaaaaaaagcaatcctagaagaagttgctaaatcaaaggtgaatttttgatattcagctacaagaattttacagacaacagatcgttttgatacaactaaaataaattaaattaaattaaaaataatcagttaaaaagctaaatttatcctgaatttaaatataattttattcataagctattaaatttctgaataaaattatataaaaaatcattttttgttaattttgaatgatttttgctattttttaagttataattacaaaagggggcgagattaaccccccttgtaattaaatgttagaattttaagaaatcataaattatatgaaaaaaaattttattttaaacttcgcgacaaaaaacgtaaaagaaaaaaaattaagctttggagttggaataactttatgagctttaatcgtttttgcttatatgatttttgtaatgaattgaggttttgcctctgccggacttaacggtaaagcgggaataagtggttatttaggtcacttttttccaaatgctaatgaagccccaggaaccgttgtaaatcaagcagttaactggggtatcacaattggtcgtggaattggatcagttcttgttggttgattaattgtgaaaatttcgcataaatatacagtaattttgtctttattttttatgctttttggaattattgccccttattcaccaacttatgccgggtttataattcttagaacaatttttgcaattggcggaacaatgcagattattttaattcaaccagttgtctcaaattatttaaatcaaaggcaaaaagctgttatttcacagttttccccttttttttatccaattggaacaataattacgcttattccttttgcaggaattattggtcaagaggctcaggaagcttttcgtgataattgacaaattgtctttttagttatcgggcttcttaccttaattccattaattggatatatcattttaggtactaaatttgatctttatccttcaaatatagaaaaaagaaacaaacaggaaaaactgagtttagctacatttttcaaacaaaaagatacttgatattgaacaattttatatggttcatgacttgtggcagtcgtttttccttttactttttcaaaaccaatttttcatcggttaataggtgatagtgatggaacttttaatgataaaatttctgtttttctaatcttctttctagcaggaatgtttcttggaccttttacaatcggacttttatccaaatatcagctacaaagacgtaaatatatatcaacaattataactcttggcgtatttttttatgtgcttgcaactgttgtttttgttttaaaagttggaaaaaattatgaatatgcaaaatcttatacggatggttgaacttgattgttcttatttttgggcctttttatgggaatttgtctttgaggaattcaaggtgttatgctaaatttacctcatgaatataaaggctcaaacccttaccgtgttggttttcagttcggtctaatttggggtcttggctataccgcttttacaatcgcaacgattattacatcattagttaacacgccaccaggaattgatctaaaaaaattagaactaaataatgtcgatggttatgctcttggagcttatattctcattattattttctcacttgtttcttcaattggtttagcccttttaaaggaaccaaatccagaatataaaaaattattaaaaatacgtagtttttctgaaattgaacgaatcaaaaaataaaaaaaatttcatttttgattcgttttaattaaaaataagaaaaaaattatcattacttgtttttaattaaaaaaaattaaatctatcaatgaaaaaatttaacaaaaaaggagaaatcaaacttatgaaacctattaaaatagctctaattggtgctggaaatgtcggaaattccttcctttatgcagcaatgaatcaaggacttgcatccgagtatggaattattgatattaatcctgattttgccgatggtaatgcttttgattttgaagatgcctcagcttctttgccttttccgattagtgtctcccgttatgaatataaagatctaaaagatgctgattttattgtaattacagcgggaagaccacaaaaaccgggtgaaactcggcttgaattagtagctgataacatccgaattatccgggaaattgcactaaaagtcaaagaaagtggctttagtggaataagtattattgttgctaatcctgttgatataattacaagggcttaccgggatgcatctggattttccgatcaaaaagttatcggtagtggaactgttttagatacagcaaggcttcaatttgcaatcgcaaaaagagcaaaagtatcgcctaattcggttcaggcctacgtgatgggtgaacatggtgattcatcttttgttgcttattcaaatattaaaattgccggtgaatgtttctgtgcttattctaaactaaccggaattgatagctcaaattacgaaaaagaacttgaatatccagtttctcgccgggcttatgaaattattaatcgtaaaagggcaacattttatggaattggtgcagctattgccaaaatagtttctaatattatcaaagatacaaaaaatattatgattgccggagcaaatttacgaggagaatacggatttcacggagtaaatatcggagttccagttgttttaggagcaaacggaattgaaaaaattattgagattagtcttaatgataaagaaaaagaaaaatttgccaaatcagttgcaatcattgataaaatttatcaggatgcaattaaaaatatttaattttttaggaaaaacagtttaaaaatctctctataaatttaatatttttatcctatgattttaaaaaagtactataaatttatagtacttttttaatttttagcaaaaaaattaaagcttaaaaatctttattttttcaaggctaaatttgagcttggaaaaaataaaattaacccttttttaatttttcttatttatataatttaaaaaaaattaaaaaaaggttataaaaattattttggtggctcatatcggactcgaaccgatacgcattgctgcagcaggttttgagtctgccgtgtctaccattccaccaatgagcctttgtgaaaatcaaaaaaaatatcaaatttaacttaaattatattataattataccaatgatggctaaaaaagaaaagaaaacttgaaaaaaatttttatttagaattataccgctactaacagcgccattttttttgactgctataggttgcacgccttttggagcggtcaaaaaaataggtggattagttgccgagattggcgaaaataatccttgagatcaagaactaaatcctaaaaaaccactagattcaattattagtgggcgaattaggtcaagatttgaaaaaattaaggcatctgaatttttaaaacaaataactttcttaaataatgaaaatagtctaaatgaaattaattcacaaattgctaaggaaaaaggtaagcttttaaattcagcaattctttgaagttttattccgggagtcgataattatgaccttaataaaaaatttgatatccaaattaaggctgatcctaattcggtaaatgatgattatggggccattaaaattaaggttgatgctttcgaaaaaggttcagaccggttagttcaaagcaaaaattttctcatttcgggatttaagacagaaataaccggaatttttgcatataaacagcgaattgcaacagcttttcagaatattaataccctaactttaaaagatgaaaaaaattttgatgttaataaacttgattctaatgcagatatttgggattttttaaatctcccatccaattttgaaaaattggatattaacaagttgcgaaattctgatcaatttgatgtacctgaatctgatgtctcagcgcctaatattgccaaaattgccaaaaatccttaccgtttaagggtcaaaaatttctattatctaaaagctaccattctaaaaaattcctatgataaaaacactggtgaaatcgatgtaattttatcaatttatcatgattcttttaataattatgtctcaaaaattgtaaaattaaagaccaaagcaaaccctggatttaataaattaaccgaaaataaaagctttaaattaaaagaaaaatatgcgaattttttaccttcttttcttataaattctcacataaatcagagtcaatcactagctgaatttattaattttggtgattttaactatcaaaattatgatattaaaattgttccttcgcttgcaaatgaccaaaatggtgatttttatattattttaaataaaaaagaaactagtctaacttctggatcaatcagtccgggtcaggtaattaaagttgaaggttttaattcctatgataaaattttttcaagtgaggaatttactagggaaattgactttgactatcttgattcttgatataaattaccaaaaacagccgatcttgctgaaaaactacagagtatttccgaaagtttaaattcttcaagtgattcacttttatgaccgctttttggcaaagcagtagaaaaagcgctttcatcagaggaattatttaaaaacactaataatttgaaaagttttgaaaaatttaactataaatttgcctcattagttgattttaaaattgatgagactggtattagtttctattttggaaattcacttcaggattattatcaagtaaaaattaaatttagccaaaaaactgaaagtaaaaatattatcgctgattttggggcaaaagttcttgaaaaagattcaataaatagctcgcttcgtgcaagatcgcttgtaattcaactccgttcgaatgaatatgatcgccaaacaaaaacaaatacaagcaaaattacatcaggaaccgcttgagtttttgatcgaaaattaaaaaaagacccaaagaatccaggaaaatttctaccaacaaatacttattatttagcgacaaatttacacgttattgctgatttactcaataaacctgaccaagtttattcattttcatacctccttgatggcagccttaaaaatcttgatacaatcagttttgatgatacaaatttattccgtcgttttgatcgtgttgcaaaaactgcaaataaaaaagattatctaggacctgaaggttttcagtatatcactagtgaatcaaagaaattttgggaaaatttaaaaattaatccaatcgggcttaatatgcctgacaaggataaattccgtgattttgcaatcatcgaaattacttttccagaagataaagtcaaaaaaaattcttttaatttcggcatcccttttcttgatcttgatttttttggtcaaccttcatatataaaaaatattcctgatgcagttaaaaattatcaaaaatcgccgcttgattttttagttactgataaattagtgcctaattttacaaaggcaacccaagaaaaaattacagacaaaatcaaaaaagcactacccttacatgcttatttaggtggatttttaggtggatttacttgaattaccgacaacaaaaatgcatttattacaactaatggaattcttaaagaaactgattttcgccaggaggattcaataaaaaaatttcaaggggccaactcaatttcgctccctggtcttcgtggtggtcatggaatgtcgggttcgcttgtagtcaatgaatataatcaagttcttggaattttttggggcggatatttcccgccaactttacctggtcaaaaccagcttgtaaaaggaattggccaatttgatccaattggtctaaaaactgactcaaatccgacaattttagcaaaatgactcgcacagactcaggatatccaaccgatcttgatgcaagacaggaaaaagtttttagccttgaggatccaaaagaactcgaaaaactcgcacattcagcaaggtgaatcaaatttgataatttcatagaaaaagaaaattcaaacatttagttttggcttttaaaaaaacaaaactaaatgttttttaactaattatggaaaaaaaaatgtttaattctctgatgaaaattcatcagaagtatcaggatttaaagcaacttttagaaacagatcagatccttaatgaccaaaaacagtatctacagattgcaaaggagattgctagtattagtgaaattattgaagtttttcaaaaatttcttgatgatcaaaaagttcttgaagatgcaaaaactattttaattcaggaagatgatccagaattaatccagcttgcaaaagtagaaattgcaactatgagcaagaacatcgaagaatatgaaaaaaaattgttaattttaatgctcccaaaagataaaaatgacgaaaaggacgtaattgttgagatccgcggggcggctggcggcgatgaggcaaacatttttgtcggcgatctttttaagatgtatcataaatgagctgattcccaaaaagcaaaagtaaaagttttaagctcctcacttgctttagcaggcgggtttagtcaaattatttttcaaatttcaggtcaaaaaatttactcaaaactaaaatttgaatctggagttcaccgggttcaaagagttcctgcaactgaaacaatggggcgaattcatacctcaactgcaacagttacggttatgccaaaaattgatgaaaaaattgagattgaaattaacccttctgatctaaaaattgatacctatcgatcttcaggagcagggggtcaatcggtaaatacaacggattcagccgtccggataacccatattcccaccggtattgtcgtaacttcacaggatgaaagatcgcaaattgggaataaagagattgcaatgggaattctcaagtccaaaatttataatcttgaactgcaaaaacaacagcaaaaacagtcagattttcgtaaattagcaggttcaggagctcgttctgaaaaaattagaacttataattatccccaagatcgactaacagaccatcgaattaatttttctacctcactaaaaccaataattcaagggagcctaaatccaataattgaagccttacttgcccaagaaaaaacggaactaattctacaaaattatgctaataaataagcgcaaattagaacttttaaaagaaaaacaacgatataatttacctcttaagatctcaaaattggaaaatttaaagttagaactggactatccgatccaaaaaattattggatttattgaaatggaaggcgttaaaattttccttgatcaaaaagtttttatcccgcgttatgaaacccaggaattaattcttaaaataaaaaaagtaataaaaaaaggtgatttggtccttgatttatgttctggatcaggttttatcggtcttgcgcttgctaaatttattaatgcaaaaataactctggcagatataagtgatgaggcaattcttcaggcaaagcttaatgcaaaatataataatttagagctaaatatcataaaatccgacctttttgcgaatattcctgagcaaaaatttaatataatagttgcaaatccaccttatttaaaagaggaaaaactagctaattcagtgcttaattttgaaccaaaaaccgccttgtttgcatggcctgagcctttttcattctatgaaaaaattcttgaaaaaattgataattttttagccgacgatggttgaattttttttgaaattgactataatagtcaagattttttcaagaaaaactaccctgattttataattgaaaaagatataaatgggaaaacaagatttgcttactgacaaaaaacggcaaaaaagtaaagaatttataacattttttaaaaattagtttttaaaaaatttgactttgaaaggaatttaatgaaaataagaactcgctatgctccttcaccgaccggatttttacacattggtggggccagaactgcgctttttaactacctttttgcaaaacatcataacggggattttattttacggatcgaagacagtgataattcacgaaatatcaaagatggagaaaagtcgcagatcgaaaatcttttatgacttgggataattccggatgaaaaaccgggttcagaaacaaaatttgggccttatcgtcagtcagaaaaattagaacgctaccaaaaattagcccaagaacttataaaaaaaggttttgcctactatgcttttgataatcaagaagagcttaaacttcaaaaaaaagaacaaattgcaaaagggatttttagtttccgttatgatcaaaactgactaaaaatttcagatcaagaaaaacaaaaacgcttaaaaaacaagcattttgtaatccgatttaaggttgataaggccaaaaacttttgctgaaatgacctagttcgcggacaaatttgctttgaaggaagtgcaattagtgactgagtaattataaaatccgatggttttcctacttataattttgctgttgtagttgatgattttgatatggaaataagtcatatttttagaggtgaagaacatatttcaaataccccaaaacaaattggaatatatcaggcttttaattgaaaaactcctaaattcgggcatcttacaataattactgacaaaaatggcaaaaaactgtcaaaacgtgataaaaatttgttccaatttatagaggattacaaaaatcaaggttatcatagcgaggcattttttaattttctagcacttttaggatgaacaagtcctgattcacaagagttttttgaccataaaagtctaattaaggcgtttgattataaaagactttcaaaggcgccttctcattttgatattgaaaaattaaattgattttcaaaatcatatatttctaaaatgccagttgataaaattcttgaaaatttagaactctctgataatcaaatttgaaaccgattttttgttgaaacttttcaaaagagtagtataaaatatgctgacttttacaaaaattttgaattttttcatagaccaaaacaagagatggatgaaaaaatgttagaaatttttgaaaaactcgacaaaaaaccggttaaaatttttgccagcaaaattgattatcaaaattgagattatacaaaaattaatgatttaatcaaagaaattggacaaaaacttgaaattacaggtaaaaatttgcttcttccaatcagacttgcaacaacttttacaaactcaggaccagaattggcaagagcaatttggcttttaggaaaaaagataattgaaaaaagactattaaaatgaaagtaaaatttttttcaggcattaatctagatagtaaaattgaaaaaataattgaatttattagcccaattactgtcacaaaagaaaaaataaataattcggaaatgcttgtctatgaaactttaaaccccgaaaataacactatgataaggcttgaaattttagatgaaaatttaactgtattttccggggaaaatactttattttttgaactaaataaggaagtggacaatgttttttttaataatggaaccgaagtgatggttagtacttttttgaaaaaatttgagcatagctcaaatttaattttgcttgaatatgatttttttctaaaaggaaataataataataataataataataataataataaaattgccacttatataacaaatatggaactaataaatgattaatattgttttatttcaacccgaaattggccctaataccggcaatataattcgttcttgttttgttgctggactaaaactgcatattattatgccgattgcctttgatttagagccaaaacacttaaaaagaccggctgcgggaattttattatctgagattgagcatgagatacataaaaattggcaaaatttttctgaaaaatacggtcaaaaaaatctattttttattacccgttatggccaaaaattgtacactgaagttgatttttacactgaaatcgaaacaaaaaaagatattttttttgtttttggccgtgaatctaccggcattccaattgaaattttgaaaaaaaacaaagaaaaatgcctcagaataccaatgatcgcgaaagctcgttcattaaatttagcaaacacagttgtaattatagcatatgaattccacagacaattaaatttcaaaaaattatcacgattcgaggtacaaaaaggaacaaattatcttgatgaaaattaaaaaaattacttcttataataacccaattataaaagaaataggtaaattaaaattaaaaaaataccgtaatttatgaaataaatttgtagtagaaggtgaaaaagatattgaatcagctatcaatgcaggtttagttttgagaattcttacaacaaaaaataatgttgaaaagtaccaaaaagttaatgttgatgtggtaatagtttctcaaaaaattcttgaaaaattatcccagcacaaaagtccatcagaagtaatcgcagtttgtaaatcaaaaaaacaacgtaaaataaaggattttttagactcaaaacgacttgtaattcttgaaaatattcaaaatccgggaaatttaggaacaattattcgaaattgttatagcttcggttttgaccttgtttattcaggtgttgatctttataatgttaaaacaatttctgcctctaaaggcgcgatttttatggcaaatatttactttttaaaaaatatttcagatttttttaaatttgggccaaaacaagaaattattatcagctcacttgaaaaagatgctcaaaatcttatggattttaaagtaattccagaaaaatcatatacaataatttttggaaatgaaggtaaaggagtctcaaaaaaactaaataaactagcggataaaaaaatttatatacccataaattttgaatcattaaatattgcgagcgcgaatgcaattttttgccatttttttcaattaaaaaaataaaaaaaatggcagaggtgacaggagtcgaacccgcaacatacggggttgaagcccgttgttctaccattgaactacacctctaaaccaaaaattaattataccacattttttaaaaaataatataaaatttaactaaattatgaatttaaattcaactaaaacatcaaaaattaaagatttttttatttttttatgatttattattaaaatttcactaatttcttttggcggcggaaatgcgttaatgccaatcatttacaaccaagttgttacaaaaaaacaatggatttcaaagtctgattttgatcaaggactaattttgacaaatttactacctgggccttcggttgtgcaaatgatttcgctaattgcaattaagagattaggaagttttttgggggttattgttacaattttgggaattttaccccatattttcctgtttttattgcttatttatgtaacaaaatttctcccagaaagatattttattatttttaatttggctgttttttctacaattattggtgttttattaggtttttcatatatttattggaaaaatgataaaaaaaatttaaattcggctgtttattttagtatcttaattgctagttttgcctattgcttttttgtgccaaacccttataatctagcgcttgtacctcttttttgtgttatttttatttattttatctgatttttaatcaaaaaatggaagagaaaaaatgatactaataattagtttggcaataatcgggcttgttttaattagtctactagtttttggcggcggtcaagtttttatgcctgtttttagctggttttgagaacaactagctcacctgggtctaaaaattgatcaggaacaaattagtcaaatttttactattgctaattcaactccgggggttatctcacttaaattagcaggaattacgggctttttaattggcgattatggtgttttgggttgatttttagccattttttttataattatttttattttgccggctatttttttaataattttttgattgagaattagcaaaaaaatagctatcaaaaacaatgttttttgaataaatttgataaaaatttttcggccggtgattgtcggaataatattagcacttgctttccaattacttaccaatttgatttttataaattatagttttaattcaagtaaaggttattttttaacaaaaaaaagcagtgaatttttagagggttgaagattttgggtttttattttttttgggacctcatgggctataattgtttttatttcttacttaaagaaaaaaaacatatttttactaataattttaggaattattttggccctaacttgccttcaaccttgaatttaaaggagctttatggattctacaagaaaattttatcataaaaaagactattttattgactatgaaaatcaggttttaattcttgaaaaatcatttcataaaaaactgttaaataaagaatttgcttttaaaactggttttaaaaaaattggtgggactttaattggtgaagttctcggacttgatagttttagctcaccttttcgggcgtttattaaaatcgcaaaactagatatgccgattttggatagaaaatatattgatgctggaattgcaattgaaccactcgtaattaaagcgctttctgataaattaaggcttgaaattgaaactttcccacccgaaaaatttaattatgactattttaaagaagattcaataattggcggaattcccgatggatttattccaaaaactaatacaataattgaaattaaaacaactggtattaaaaatttagaaaaatgaggccaaaaaggggaaaatttaccccaaaaatacataaaacaagcacaattatactcttttttaaaaaaagcaaataaatttgtaattgtggccacctttcttaaggactcagactatgaaaatcctagtaattttcctattaaaaaacggcatatcaaagcttatagttttaatgtcaatagtcaacaagttcttgatgatatcaaaaaaatcaaagaatgatataattattatacaaaattaggaacctcacctaaattttgcttagttaatgatgcccaaattcttgaatatttagcctgcgagaatgaggatcaatggaaaactcttctggaaaaatggcttaaatcaaattaggaaaattttttaataatgaaatcacagtcaaaaatttatctatataaaaatgttttaataattgtctctgaaatgagccaaattataaatgaagcaattaaaattcatcaacttgataatattaacagtctagttttggcaagtgcaattaatgtttttgggccgctttcatacctaattaaagaagaaaaaggcggattttcaattaaaatattctctaaaaacttagaatcattagtgatcgaaactaacaaaaatggccaaattcgggcaagttttaacaataaaaactacaaaataccagatgaatattttaaaaaatacaaccctaacgagttagtaggttcatttgtcgggaattctggttttttaaaaattaataaatttggtcaaaaaaatgattattcaggacaagtgccattacaagttggtgattttgtcagtgatttagctttttatttttatcaatcacaacaaacaagatcagcgataaaaaatttaattgaaattgatcaaaatttaaaaatcactaaagcacaatcattaattattcaacttttacctaattattcagagagcgaaattcaagaggttgaaagctgactaaaaaacaaaaagatcaaagattttatagagttttttgaaaattttgaattaattggaagtaaaaattgaacttattattgtggctgtgataataaaaatttaattgaaaatttaaatttatttactgagaaggaagttgatgatttaattaaaaattaccaaaaaattgagtttgtctgtaatttttgcacaaaaactcaaagttttaccaaaaaagattgagtttttgccaaaaatccatttagccttgcaactgttgaatccttaactggaggcgcacttgcagctgaaattgttaaaacaaagggagcaagcaaattttttgccggtggaattgtttgttatcaaaataaaattaaggaaaaaatcggaattaagacagaaaatggagttactaatgcaaaaacagcgctaaaaatggctgaatttggtcaaaattttttccagactaaatacgtaatcagtctaacaggaaatgcaggcccagaaattcaagatggaaaattaggccaagtttttattgctctcaatgaaaaggtatgagagcttaatcttgaaggtgatcgtttgaagataattaatgattgtattaaatttgcagcggaaaaaataaatgaaattagaccaaatactattaaaatttaaagatttatattataatatatttacattatactaaattaagcaaaaaataatgataaaatataagtatttttattattttttttaatttgaattaaatttacttaatttagattataattatacttatttttatttttttacttagattttgaaaattaacaaggttaaccaaattaaattgaggacgaatttttaatgataaaacgtgaatttttacctgaaagtgctgagctaaaaataaagttaactgcagattctaaaaaatgagctgaattctaccaaaaagctgaacaaaaacaggcagcaaaagtttctttacgaggttttcgcaaaggaaaagttcctctagaaaaagcaagagcttatttaaatccgcaagctgtttttgagcttgccctcagaatgtttcttcccgaacttgaaaaacaggcggcaacaaacataattgatagtgacaatgttattgaatcaccaatttttaacatagttaatatggataaaaataatttagaaattgaatttctttatccggtttacccagaaattaaattgcctgattataagaaccttaaaaccaaatttgccattaaaaaaataacaaaagaagatatcgagctgcaaaaacaaaaacttttggaagcaaaaggaaggtttatcgaagtaaatagacctgtaaaaataggagatgttattaactttaactttaaaggttttattgatgatgagccttttgatggcggtgaaggagaaaactttgaccttcgaataggttctaatagttttattgccggatttgaggaacaacttgttggtcttgaaatcaaaaaagaggccgatatttatgtaacatttccagaaaattaccaggttcatacctatgcaaataaaaaagcacgttttcgcgtaaggattaataaaataaaggaaaatcagccagcaaaattaacaaatgaatttgttgcatcactaaaaattcaaaatgttgaaacaattagtcagttagaagtttatctagaaaatcttacagagcgcgaaaatatcgaaagagcaaaaattgatttccaaagaaatgcacttactgaaattggagaacaggttgaggttcccttggctaaaaaattaattaacttagaaattgagcgacttaatgaagttttccattcaacactcaaacaacaagagattccacttaaagaatatttgaaaatcactaaatttactgaaaaagatatatacgaccaattcgaagtagaagcaaaaaaattgctaaaaaattctttcattttcgccgaaattgcaaaattagaaggacttgtgccaactcagcaagaatatgaaagccatgttgaaaagttagcaaaatttactggaaaatcagttcaggaaataagcgaaactgtttcttataacgaaattcagattaatatcactaatcaaaaagtaattgataaattaatcgagttcaatcatgaggcaaaagatgaggaaatagttaataaaaaccaaaatgataacgaaattgaacaggataaagaacaaaaggacaacaatgaagaaaaaataaagcaagaaaataacttagaaaacaaataaaaaattaaaattgttcttctaaactttattttttacaaatttttaaaaattaataaaatcataaaaggaggaatatgtcacgatttacgcgttttttttcaacagttttagcggttataatcggaaatgttcttttatttgggataataatcgctactttatattttttatttaaaaaacaaatagaaaattttaaatttgataaaatcacaaaaacaattaatgaaatccaggaagcagttgggaaattagattcagcccaaataaacaaatttcaggaagggcttaataaatttacgagtttggattttgatgccttgaaaaaccaattcgaatcagtaaaaacaataccttctaaattagaccaaattctaaaacaattacaagaaatttctgaatcactgaaaaaagtacaaaatggctctgtatctcaagctgctcatgcgcttgtaaatacaagtatttttgaatttattaatcgagttaaatttttataaattttaaaaataacagttttacaaacccaatttatggaaaaatttataaattgggtttttttattaattaaaaaattaattaattaattaattaattttttaatttttaattttgttggtttttcagctaaaaaagttccgactacaataacgtcagccccagaatcaaaaaccttttttgaattaaaatccttaatgccaccatcaacttgaatgataattttataattattttcttgaattattttggataattcttctatttttttataagtattttcgataaaagcctgaccgcctttgccaggttcaactgacattattagaactagctgaatttcgggtaataaatcataaatttgttctatttttgtctcaggttttattgctattcctattttaatttttcgcgaatattttgatattatctctttaatttgagcataatttctactttcaaaatgaattgttgcaaaattcacataccctagtaattgcttaatttgctcttcgggattaacagacattaaatgaacatcagagataaattcttttgattttttaataatatttttgatttctggaatagatattgctacattcttaacaaatataccatccataaaatcaaagtgaaatcattttatgccaagattcaaaaaaattcttgttgattttagccgactagatttttttatattcaaaagcgaggggctaataatttttcttttcatattttcctaaaaaataaagataatttttataacgattttctggtatttttccatcttttagcgcccttttaatgccgcattgatcagttttctcctgaaaatgaaagcaggaacggaatttgcagtctgatgaaaattttttaaatattttaaaagcattgcgaatttcatttttggatatctcgctgtatgaaaacgaggaaaaaccggggctatcaattatccgaaaattttccttttcaataatttggacgactctagttgtatgctttccacggtttagtgtctgggaaatctcttgaatagcaaattttttatctaaaaaattattaataaaactggtttttccgacaccggtttgaccgataacaaagttaagttttttttctaattcggcttttaattctacaggaatttcattttttttattattaataaaaaaaatgttataattcattttttgataatcaagtaataaattttcaaaattagaatcaagatcaattttagtaactaataaaattacaggaatattttttgcttcaattaccaataaaaatttatctaataataagcttgaaaaattaggttctctaatcgaaataaaaactaaagcttgatcaatgttggctacttttggacgaattagctgattttttctttcataaatttttttaataaagcctttttcttcaaaatcaacaaagtcaccaactattggcgatgtttcattcaaccgaagaaggccagaacctcttaaaagcgggtataattttcggtttttaggatcgacaacatcataaaaaccggcaataattcgaacaacttgccctttcatctaagttttttggatctctttacttataattttttctatttgggcaacacattcttctaaattgtcattaaccacttgaaatttgaacaaatttttaattttaatctcagctttggctttttctagtcgttgatttatttgaatatttgtttctgttagacgtttttgaatccggtttttaagagattcaatggaaggagggaggataaaaatagttaaaagttgggataattcacctttatttttgtaattttcaataatatttttagcacctgttgtatcaatttccaataatgggataaaattttgagactgaataaacttaatctgcgattttagggtcccataataattattaaaatgacaacttcattcaataaattcatcattttcaattttttctttaaactcttgaactgttaggaaaaaataattaactccgttaatttcgtctctccttttttctcgagttgttgcagaaattgctaactttattaataaatttttattttttaataaaagtgattcaattgtgcccttgccaacccctgaaggtccagacaaaattattaatttactcatttttaccttcattgtaatattttaggaaaaaaacgctgtttttaccgtatttttttatttgatggattgaaaaaatgtccggaattagtttagagcctaaatttgttttataaattataagtccattttttgctaataaattattttctgcaatttttcagaaacatttttttgtaatttcttcttcactatggggaggatctaggaaaatgaagtcaaattttttatttttaagatcattaattaaaaaaattgcacttttattaaaaatttgataatttttaatattatattttttacaaaaatctactatattttggtaagctttttggtttaattcggttgctaccacctttttagcgccacgagaagtcgcctccagcccaatcgctccagtaccggcaaataaatcaagcaccttagaattaggaatttcaaattgaagttgggaaaaaattgcttcacgacaacgactagacattggacgcaccactgaaaattcaggatttttaataaccgcaccacgataatttccggaaataattctaatcataaatttttaaaaattataccaaaagtttatagaaaaatgtatgaatttttatttaaaaataattttaaaacatcaaacaaagaataaatataataaaaatcaattttttctaaaaataaatctaaactaaaatctgatcaataaataatttctaattcttttggattaaaacgaattaaaggttttaagcttcgatggcgaaaacattccatccccccagcaaaatcaaaattcactaatcgttggttggttttgcaaaccttacaacttgtaagatttgcaattcaaccattaaatttaatccagttaataattgtataaaccttaattgcatcagcatttttggcgttaattttaaaaaatgcttgttctaaaattggaaaaattttaggttcaaaattttgctcatgcataatttgtgaggaaaattttcaaaagttataaatatttttattaactaaatccaaatgcagaaaacattcgcccttttttaattttgataatttattaggattttttgctaaaaaaatctcaaattcacctaaacaaccaagatttagtatataaatatttttgcttgttgtttttctaacgcctaatgctaccatttttataatgccaaaattagtggctaatttaattattagatcaaaatcacgaaaattaagtcgatcaacaataattcctttaataattttttcagccatattctaagaaaaaattcctatatattagtgataaaaaataagtatttaaatttaatttggattttaatattaatttaattaaaaaaatttaaaaaatttttaattaatttttgttaaaaaaataaaatttggtataattatttttggttagtaacaattaaaagttactaaccaattacaaacatttaattatttctctattttactattttttcttatttgtatttggtaaaaattactttattctaattaataacatattttactccaaaatcctagtattttttttattattaactgccttttgttgttactgtaaattttatttacattgtatttgggaaagtagttagggtagatttaataattccattttcatatatttatttccttctaattaaatgaaataaagttagtaacaaaaacaattttagttgctaactttattttatttaattaaaatataaaataaaaatgacttaatacccgaatctttttatcattttagggttattaaatcattttttcgctatagacacgcggttttttagaacaacttttttgccgaaaatctcttcaagttctctacgggcatctgttccgatttttcctaaaaccgaaccacccttaccaattattattggtaaatgtgatttttttcctacataaattgttgcctcaatttttacaaaacggttatctgattcatcaaaattatcaattaaaactgcgctttgatgggggatttcgtcttcaagatttaaaagtatttgttttctaataatttctttggcaaaaaaacgtgaactttgatcagtaacatccaaattactataaaaatgttcggatggataagcaaacttttcaatttctaatagtaaattaatacgtaagtcttctgaatttgttgaaaagggtaaaattttttcaaaattaagttcacgaaaatttttctcctgaattttaaaatttaatttatcattttctaggtcagttttagttatcaaaacaattttattcatatttttagcaattttttttgccaaaaatctagtattttggtcaactggtttatcaaccgggtgcaaaaaaaggaccagatcaattccttcaagtgttgagttaatcgcataatttaaggaattacttaaattattaattcgcatatgaaagccgggagtatcgacaaataaaatttgaagattatccttattataaattgcatttatggcatcgcgggtagtttgtgactttaaacttacaattgagactggaaattccacaagcgaatttataagtgaggacttaccaacattaggtaaaccaacaattgctacaaaacatgttttttttatatccataaattattaaaagaaatccttgttaaactggtttggcaatagttgatttaatgttctttccctaaattctgacttggaattataaagaaaaatactaactttttctgaaaaaaattcagcacaaacttgcaaacactgaccacaagggataatgaatttatctgtatttgggctataaatgtgaatttctttgaaagttttaggttcaatttcgcttgcaattgcctgggttattgcaaccctttcagcgcaaattgttgcgggaaaaacggcattttcaacatttacgcctttaaaaaattggccagaagtagtcactaaaattgcagcaacggcaaaacctgaataaggacagtaggcttttttacttaatttttctagttctaaaaaaatttttttcattatcgattaattcctaaatttattaaaatattttcaactttttcatccattaacttatttgttttttcatcctggtgatcaaagccaagcaaatgatagatgctatgaacaaaaagataagaaaactcacgctcttctgagtggccatattcatttgcttgttttataatttttgctggggtcataaaaatttctcctagaaaatgaaggcgaaaattttttttagcaattattaaattacttggaaaagacaaaacatcagggatataattgatatttttgaatttaatggctaatttttgagcttttctttgagttattaacatcaaatctagactaatttcacctgttatttgctctttttcgactaaaagtttaaaaattttcctaaacaactttaaatatttaaacttaattctgctttgattaaggaaattaatttttgccttcatttaatataattttacaattattttataaaaagatcaaaaaaatttccattatccttaagaaaaagtactgccggtatttgtgttttcggtttaagtaagagtgattttgtaaattcaataataaattcattttgttttgtattagttatttttataagttcaagtctaatactgcggtcctgaaattggaattgagcaaaggaatctttatttaacaaataataaatatcagaatttatttttgcaaaagttttgtgtttttcatcaatttcaagtataaaattaattgttttatatgtttttatttggaaaaaataataaagactaatcgacattaaaattaataaaattatactaattaataatgaaattttactgttttgatatatttttgatatcaagtatttctccttcctcgtttataaatctttttgagtgggaaatttcgataaaaaaagcatttttttgataatttgtaataactttttttaaaaattcaaaatttttttcatcaatattttcaaaagcctcatcaagtaaaattaagtcaaaatcttgtgttaataattgcaaaagtgcgattatttgcttttgcccacttgaaaaatttgagccattattaacaaattttgcatcaagtgaaatttgtcattcataaagcatttcctgaatatcaaaacgctgaaaattatttattaaattctgaattttttcaggattttcgtttgtaataaaagaaagaaccgaaatacttggaaagtaattatgggattttatataacaaattcttttgcgaagttcgttttggtcataatactttagatcaagattattaattaaaaactcgccattatagacaatatcttgatttaaaagtcttaaaaaagtggatttcccacttccatttttcccaattattcgtaaattcccgttaatccgcattttatcaatataaaaaagtgtcttgtttttatagtaactaacgcttaaatcttttaatttaatatcagaaattttttggtggtatttaccttttgcttccttgtcaatatttaaaacaaaatttaatagttctaattctcttaaaaatatcggtaaatttgtaactatatcgacaaaagatgagagtggattgataaaaaaactaaaaaaacttaaaaaaagcaaaagttctccaatcgataattttttatcaaaaattcaaaatgaagacactaaaacaattaggattggcgaaattgaaaaaataaaattattaaaacttgacaaataattttctttttttcaaatgttaaattcagtatttttataacggtagtatttttcatcaaattgacgctttaaatttttataaacatcatcccgctttaaattttcaattgaaaaaattaaatcattagtgcttgtaagactatttaattgatcttccattaaaaatcgatggttttttgtgatattttttctaacaaatatactaactaaaagataaactatactgatagcaataattagcccaaaaatttttacatcaattcaaataagaataaaaaatgaaattaaaaaagtgattaattcattaaaaatatggtaataaaagctagcagaaaaactagcaaaactaggaattaaatttattcgtcgaatataatcatgattatctaattttaaaagttgaaaattttcccctgtttttaaggcgctaaaaaatcgatcaaaaatttccttttcaattttaagttcaattttatgaatataagtttttttaaaaatatcttgtaaaatccgccaaaaagcaatccagataaaaaaaatacaaactttgaccaaaagcgaaaattcagtctgcgggaaaactttatcaataacagttttcataaataatgaggagacaaaattactaaccgcagtaataaaaaataaaaaaagtaaataccaattactttttgcctcaaggaaaaaccaccaattatttcagcttttatcttttttttttgattttttataatcaaaatctttttgggcaaaaatcacgacgttttggaaaattttctgcatttcagttttagtaattttcatttttccttttaaagggtcgataatttcaaatttcctttttgtaatttttgttagtaaaacataatgatttagatcgcctgttttaattaaaataattgttggttttccgagttctagttcttgtagattttcaaatgatccgccatatgattcaagaataatgccaaaatccttggcaacacgttcaagatttgcaatatttatgccatcatgtgaataaaatgcctttgtttttaggtcatttattgagatttttttatcataaaaatgataataaattgattggagaaccgcaagtccgcaatcccttaagtctttttgcaaaaataatttcattctctgttggaaattatgataaaaatagtaaaattataaaaaaaagtgaaaaaaataggaaaaacaaaagtaaaattatgaaaaactataaatttaaaagaatttttttaattgtaactgactcgcttggaattggtgatgatggtttccaaaaaaaatttaatgatcaaggcgcaaacactttatattctgtctctaaaactggggaactaaaaattcctttttgaaaaaaaatggggataggaaatatcgccaaaattgaaaattttggcaaaaaaaataaacaaccacttgcttatgtctcaaaaataatcgtaaaatccaaagcaaaagatactcttgctggccatcttgaaatgatgggaatcgaaactgttaagcctagcccaaattttgatgatggatttccagatgaattaattaatgaactccaaaaagcctttgataatcgtcagattattggtaataaatcaattagtggaactgttattcttgcagaattagggcaaaaagcaattgatgaaaataaaataattgtttatacctcaccagattcgactttacaaatttgtggacatgaggaaaaattagggcttgaaaatctttatcggtatgcaaaagcggcccgaaaaatttgtagctctcggccagaatgaaatgttgctcgtgtaattgcaagaccttatataggtgaaaacggaaattttaaacgcaccttcaaccggcatgattatgcaaatattccgccgaaatcaattcttgattccttacagaaaaacggaattgaaactattggaattggaaaaattggggatattttctcaaatcaaggtctagataaaatttttgggcctaatagtgatgaaaataatatggatatcgcaattgatattgcaagtcaagaaagtgaaaatcaattcatttttgttaatttagttgaatttgactcaagttatggccaccgtcgcgatgttatgggatattgtcaaaatttaaacaattttgatattaaattagctaaactaacaaatgccctaaaagatgatgatttactaataatttcatctgatcatggaaatgatccttgttttcccgggacaaatcacacccgcgaggcgctaccgcttacaattttttcaaaaaaatttaaatcaaaaactaaagaattaaaaaatccaatttcttcactggccacaatcggcaatttaattgcaaaaaattttggaattgaaatggctgaaattggcgaagatatttttgatttcctagactaaatttttaaattttaactaataaaattgaaaaattatgttaaaatagtttaatctattgaatgaagtttttcaatttgttttgtaaaaattcaaaagaagtaaaattataaacatctaaatttattatttaatttgatcaaaattaactaaatagagcggactgagatgaaggaatcggagataaagtattttagcaacaaaaaaaatcaacacaaaaataaagtcaaaaatagtgaaaaaatagtaaatttgtctaaaaaattaaaggttaattttaatgttgaaaaaaatttaaaaaataatgtctctaattttaaggaaaaaaaattaaaaagcaaaaataaaaaaaatattagtcaagtaagaaaagaaaatgaaattagtgtaaaaactgaaaaaaaaactaaaattttagctaaaaataatcaaaaaccgaaaaatgctattgaaaaattagataatgaaaattttaaagctaaagctatagaaaataataaaaaaatagaatttcgaaacttaactaaacgacgtttaggacgaatgggggttatttctgtaatttatatttgacaactttttgacaaaaatatcgatattaaagagataaaaacaaaatattttgaactaacaattgaccaattaaagttgcttaattttataaaaaaaaattatagttttttaagaaaagttattaatttacagttaaaatccaactgaaattgagaaagaattttgccattaattaggtcaattttactagtaggtgccgcggagttattttttgtgcctagtcgaattgtttttaatgaggcagttgagataactaaaatttttagcattgctggtgacaatgaattttgctttgtaaatgctgttttacaaaaaatatacaattattatgaaatcaaaaatctttttagaaattaaaaataagtccgaaattaagcgttttattaaaaatgaaatgaaatttagaaattatcgtcgaattttaggtaaaaaattcaaatttttattttataatttatcaaaaattcttgaagttgaaatttcaaattataaatctgcgattcttgatctagaactaattaaaaatattaataaaattagtaattggattttttgtatgagtaaatttttaaatgaaaatttaattataaattttcgtatttataaaaatttagcaatttttttatattatagttgaaaaatacaccttaaaaaatttaaactgcatacaaaattaacaaattacgaagacaagcgccgggacgcttttaatgccttatcaattgaatgaattaaagttgattcggtgtttaatcttaaaattattgcgattttaaagaggtgaaaataaatgaccctactcgaaaaggttttaaaaatgggctttgaaaaggcagaatcactaattcgtacaggttatgtaaagctcaataatcaaacttgttattttccaggtcaaaaaatttcaaatttagattccattaatattaaagaaaaacaaaaatatgtctctcggggcgccttaaaattacaagccgcatatgattatttcaaacttaattttcaagataaaattatccttgatattggcgcttctaaagggggttttactcaattttgtcttgaaaaaggagctaaaaaagtttatgcactagattcagggactaaccaacttgattattcactgcgaattaaccctaaagtttgtgtaaaagaaaagacaaatatcaaatttgttgataaaagtttttttaatgatgaaattgatctaatagtttgtgatgtttcgtttattagtcttaaaaaagttttagtggtagttaaaaatttgttaacacaaggtaaaaattgtatcacacttttaaaaccgcaattcgaagcaaattcaaaatatgtccaaaagggtggaattgttccaaaactataccataaatttttaattaatagaattattgaatttgcaaaaccaagttttgaatttctcaatttttttgaatcaccaattaaaggacaaaaatccaaaaatacagagtattttttacattttattagaaagaatgactaactttaaaaataattttccttttcttaacaaggttacttaccttgattctgcagcaatgatgcaaaaaccactttctgtaattaaaaaaattagtgacttttacttaaattcagctataaatattcattcacagaattcaaaaataggctatgaaaatagtgataaaatcggaaaaattagggaaaaaattgccagatttatcaatgccgaatcagaagaaattatttttaattctggaacaaccgaagcaattaacttatttgctaatatgattaaaaaattcctaaaaaagggtgatcagattttactttcgcctctaaatcattcatcaaatttaataatttgaataaaaatagcagctaaaataggtgccgaaattatttatagtaaaaaaataattgataaaatttcaccaaaaactaaaattattgctttttcacaaacgaataattcaattttagttaatctgaatttggtggagatttggaaaaaggctctaaaataccacgcttttgtatttaatgatgctactcaggcaataaattatcaaaaagttagtctgaaattatgccatggccttgctttcagttcaaataaattttatgggccaaccggccttggagtcttagcaataaaaaaggaacttcttaataaattagagccagttaaatttggaggaggaacagttgcagaaataaattctaaaaatatagtttattataatggttatcgaaaatttgaggcaggaaccttgaatttagcagcaatttgggggcttggtgctgcagttgattttataaatgctatcggaattaaaaaaattgccaaaaaactacaagttttaagtatttatttatacgaaaaacttgaaaaaattgaaaaaattgaaattttttctaaaaaaggcaatcatattataatttttaatattaaagaatttaacgcatcggatgttgtctcatatctaggaaataataatatttatgttcgcagtgggacgttttgcgttccttttttagaaaaaatactaaagaaaagaagctttattcgtgtttcactagcattttacaatgattttaacgatattgatagactaatttcggttttagaaaaaaaggagtttttgaattttgtataaggatttcagcaaaaggcgtgatattattttaagttcaaataaaaaatttaatgaaaaaaaacgaatttgtctaacaaaaaatagtcaaataaatgaaaattgtgatgatagggcaagtcttgatttagaaatttttgagaaaaaaattgaaaaaattcaattttgcgcttcaggatgcagccttttgattgcaagttgttatttatttgagaaaattctaattaaaaaaactataaatcaagtcaaaattttactagataaatatgaaaaaatgataaattttcaggaaattattcctgaattagacagtcttaatgctttagttatggtaaaaaatcacccaaatcgcctagtatgtgtgaatataccagtaaaattattaaaaaatcaactaggaaattatgaaaaaaatcagaattaacaaatttttatcggaaatgggggtttgctcgcgtaggcaatctgagaaattaattttacaaggtcggataaaaataaataacgaaactgcgaaaattggacaaataattagtcaaaatgatgtaattgaacttgatcagcaaaaaattactaaaaaaccaccaattttttgatatgcattaaataagccaaaaaattacattacaagccggtttgatccagaaaatagaccaacaataatggaattttttagtaaaaatgaatatctttttcctgttggaagattagatttccaaactaccgggttaattttgatcacaaatgatggaaaaactacaaataaattattacatccaagctcaaaaatcgagagaacatatttagtaaaaacagattttagtctcagtgataaagaaattcgcttcttaaatgataataaaatccaacttgatagtgttaaatccatccaaaaaattaaaaaatgtagctccagaacttaccttgtaacagtttggcaaggttctaaccatcatatcaaaaaactatttttgtcaataagtaaaaaagttctaaagctgaagagggtaagttttgcaaatattaaactagataacatcagcgaaggcaagtaccgaaaactaacaaatcaagaaattaaatcactcgagaatcaagtaaaaaatacgactagattaggtgactaaaaaattaaaaatttacatcaatttacgtattctttttgatttttatattaaattttttgatataaaaatcaaaaagaataggaaaatttgcctcgcaaccctaaaggttttttttctttaattcttaaaataaaaattattatataaaattaaaaaaacacttgtttttaaagtgttttttttactttataagcactaaaagaattatctagactagttcaattattgccatttttgaattatcacctaatcgacttggaattctaacaatccgagtatatcccccgtttctttcttgataacgaggtgcgactttgttaaataaataaggcataactttaactccatctctggtttttaggccataaaggaagctaagaatttgccgacgggcggcaagatcgtttttttttgcctttgtaattagtttttcaactaccgaacgaagtcgttttgcgcgatcaagggttgttttaatatgtccatgtaaaattaaagaggttgcaagtgaacgaaaaacttggcgatctcaggccgcatcatgccgataaatttgatgtggatttgccatttttaattttctcctttattttcgtttttatagttttgtagtttttccattatctcttgcaccgattttcgtccaagatttttaatattctcaaaatcatcttgactaagtttttcaatatctgaaattttataatactgcgcgcgacgaagggcattaagtgaacgcacagaaagatcaagtgcatcaatactatttgaaaaacggcggataggttcttctttaatctcttgatcaccaaagaaatcagcactgaatttattaaggttttcaacatcggcaagcaaattaaggtgggcaataagaatttttgccccctgcgaaagagcatcttttgcaaaaatagatccatcagttttaattgaaaaatttagtttttcttcaattattggacttgctgagttaatttcaacagcttgataatttgcatttaatacaggcgaaaaatcactatcaacggctaaaacagacccttcaatttgggactcaagcagcgaaattacctcatttacatactttttgtttgtttcaaaatctacaaatcctttaccatttgtaataaaaagttcaaattttaaagctcctactttggaaacatcagcaatatataaatccggatttacaattttaagaccactgtgagattcaatatcacgggcataaatttgccctgctttttgacctaaaaaacttgccacgtggattgaattttgactaaaaacacttggattatagaaaaaacgtactctttttaaattattaagaattgtgacaacatcttcaattacatcatcaagaacggtaaattcatgttttattccctcaattttaaccccaaaaactgcacaggaaggaattgacgataaaactgttcggcgaagcgcatttcctaaggtattaccgagtccgcgttcgagtggttttatttcaaagcttgtttcaaattcattaacttgttcaacaagattttcagaataataaacttttgcgtgttttttcataagtttttaccttttttcctggcgtttaaatcattttcgaggtgggcgtgttccattatgtggaactggagttacatcttttgttaataaaatgttaagtccggaggtaataatttgttttcgggccgcttctttgccctgtcctgtcccttttagttcgacaatcacctcccgaattccatgttcgcgcgctttttgagccgctgcagcagttgctaaagttgctgcataggctgtcttcttctttgttcctttaaatccaactgatcctgaagatgcccaagaaattacatttccttgtttatcagtaaaagaaataatagtattttggtgcgaagaatgaatatgagcgatgccgacggtaacattttttggacgaagttttttaactttttttacattagttgccatttttatttacctttatcctttttagccataattgtttttcgcggtcctttacgagttcgggcatttttttgggtaacttgaccacgaacaggtaagccttttcggtggcgaattccacgataacatttaatttcaattaatcttttaatatttgactgaacctcgcggtgaagatcaccttcggtcttataagttttagcaacatcacggatgacttgtaaaacttcttcatttatttcttttaccttggtgttttcggttaaaattgggaatttttttccaaatttttcttcctgtaactttgccgttttttcaacaatttctgttgccagcgatttaccaattccaaaaatgctacaaagagcaatcacaatccttttatgatttggaatttcaacatttaaaacacgtgccattttgaatatttagttaaatatttctcctttttttagatttttgtaaaaaatgaaattttttttaaaaatcaaaattttttagtttttttaaataaaaaaatttttgatttctatttgaaaaagattaaaactataaaaatctagcctaaccttgtctttgcttatgcttttttattaaacaaataacacgattaattgagcgtcgtttaataattttacaatctttgcaaatttttttaatacttgcacgaactttcatatttttatcctttaaaatttatttaaacaatttagttatataaattatttaaaccggtaaactattcttccttttgataagtcataaggcgaaatttccacctttaccatatcaccaataataatttttatatgatgaattttcatttttcccgcgatatgacagtttaatttaatcccattttcgagagttacctcatattcctgggcattaaaaacgtgggtgacttttccctgaaataatagtttttgttcttttggtaaatttgccatctagttttgagccatttctgtaagaattatccctctaccatccttaattaaaattgtctcttcataatgggaggtttttctgccatcttttgcttttaccgaccatccatcctttaaaattttaatatgcggcgaggtttgtagaatcattggttcaatgcagataaccatattatcaactaactctatcccttttttggggatgccgaaattataaatgtttggattttcgtgtaattttttgcctatcccatgaccagaaaattcatagggagtgaaaaatccataggattttattacgttgttaattgcaaaaccgatatcacctgtttttgctccaggttttatcgctttaaaaccggcaaaaaatgcttcttttgcgcagttaattaatttttgattttcttgatctggtccaagtgattttgtaaatgcactatctacaaaaaaaccattataagaaagtcctaaatcgattgaaacaagatcattttctttaatgacatattcactggggattccatggataagaatttcattaacacttgcacaaattgttgccggaaaaccgtgataatttagaaaagctggttttgcatttcggcttttaatctcttcaaaagctatggcatccagttcttttaaagagattcctggtcttacaaagtcataaatttttgccttaacttctgccaagattttgccagcaattttcaactggcttatttcaaattcatttttaattatagccatttttcaatttctataactgtttcttcaagggtttgctcggcatctagataatatattataccactttttttgaaaaattcaacaattggaatcactgaattattgaatttttcaattcgatgtgtgataatttcgggacgatcatcatttctggtaattaaatcggtgctatcaaggtcacattttagttcgtttttcggttttgcaagcaataaattataagatttttgacatttttgacaaaaaagtcgctgagaaagacgcgaaattatcgtctcattttttatttttagataaaaaacacaatctagattgatgccatttttgatcataaattccaactgttgaagcgttcgaggataaccatcaagaatataaccttgatttttagggatttttttgataaaatcagcaactaatttatttgttatttcatcagggacataacttcctgaacttaaataattttgaatttgtgctgcaaattgggaatcttcactaattttttttcgaaaaagatcacctgtagaaatatgaactaacttgtatttttcaactaaaatttttgaaatagttcctttacctgagccaggagctcctataaaaagaatttttttattgcttttcatttttaagtttgccttcttttaatcaaaaatgttaaaaattaaattttaccataaaagatcctgatttgaatcaatagaaggagaattttttcgaacttgtaaatttttgcggatctttttactttgttttagaactttttgtgcatcataacgggctttgatctgcgaaatcgtttcaagtgtagttgttgctaaaattattatcgaagttcctgaaattgtgattgccgaaggaagacctaacataatttcaacaggttggagaattcctaaaaaggtaagataaatcgcactgaaaactgaaagtcgcaaaaccactgaaattaaataatcttcagtctgttctcctgggcgaatcccagggataaaagttgaatttttggcaaaatcctgtgcaattttatcaactcgggattgttgtaaggacattattattgaaaaggagacattaaaaacaataaaaatgataagaccgattgggtgataaatttgcatattattatctattcaattccgaactgctgaggtatttctatcaagaaatccgctaaaaagtgtcggcagtgaaacgataattaaggcaaaaattacaggcataattccagcaggatttaatttaaggggtaggattgaaatttccttaatattttttgacatacctgatccggtttgttgaattggaatttttctttcagctaaatacacataaatcgcaattaataaaataagtaaaaatccaaaaatataaagaataaaacttaaaacctgagaaattagcgaagaggagaaactaagatcgacaagatactcaaaagcgtgttgaaaacgacgaggtagacccactacaattccagaaaaaattagtaacgaagtaccatttccaacgcctttatccgtaatttgttcggcaagaaataaagaaaaaagtgaacctgctactaaaacaagcggcaaaaccaaccagataaaaactggtgtattaatttcgaggcgaacaaacccataatcaggattaagaatgactgttcgtattagcacaacagcctggataactgccactaacaaggtaagaaatcgcgttattatgttaatttttcttctacctgcagggcctgattgtgatagccgatggattggagggaataattttgtctgggcaattagcataaataaagatgccgtaatgaacgggctaattccaagagcaactactgaaaaattcagcaacccgccaccgccgacggtatttataattcctaaaaaggaattagaatcaagttgaaactgtagcaatttcaaccctgggatagtaattgtaccacaaactataaaaattacaagtaaaaaaaatgtaaaaattaatttgcgggctaaaattttttccctataggcaaaataggctcgatttttcagactaacataggcagaatttattccaagtcaaaccttagccaataattttagcactagcgaacctcgatttttccacccttttcttcgatttttttctgcgcggctattgaaaaagcattcgtggtaactgttaactttttagttagatccccgtttgcaagtaatttagctttcatatttcgttttttgaggacctttttaagatacaatgactctaaactaacagtatccccgtcttggtagcggctctcaaggtcactaatattgaaaatttcgtattcttttttgttaaagtttcgaaatcctctttttggaacccggcgaaaccaaggattctgacctccctcaaatccaagacggactgttgaacgttttttttgccccgactgacctctaccggcttgtttaccttttccggcggcatgtccacgtccttttcggtgtttttcttttcttgccccaggggtataactaagattttcaagtctaattgacatttttcttccttattttctctaagtttgataattatactgtatttttttaaaaaaccaagttttttttaaaaaaaaggaaaaatttgggaaaattagccagtttttccaaattttaaactttttgcgcctgcgcttgctgtgggcttaaatcacgtaattcggctacttgattaattgttcttagtttcaaaagtgcttttaaggttgctctgaccacgttgatttttgttcttgatccgtaagtttttgtataaatatcggtatatccggcaagttcgactacagctcgcactgtatttgaagccacaattccttttcctcttggagctggttttattagaatttttgaggctagatacttaacagcaatttcatgaggaacagtggattttcgataaattggtacacttacaaggcgattttgggcgtcttttattgcttttttaactgcatcttggacctcattagctttgccatgaccaaaaccgactcttccttttttattaccaactaccgcaaaggcactaaaagaaaagcgacgaccaccttttaccactttaacaacacggtgaattgcaattactctttcttcgaattcaggtttagaatttttatcccgcgaattttttctaagcggtctacgccgttgaattggtttaacttcacgtgaatttaaagggttttttgcaactgattgggaatttagttctacttttggatcttgatttagtagatctttttggttttcaagttttctatccatactagaattttactccttgatctcgcagggcatttgcaaatgctttaacccgaccatgaaaaagataaccaccgcgatcaaaaatataagactcattttccaaattaagctttttcatctttttatataaatcaggggctaaacttgaagctgagacaatattacctttatatccatttgacttatcaagagttgagaccgaagttattaccttattttttcaaggatcaaaaatataagcataaaagttgcgtaaggatttataaataccaattcgatatttttgcttgtcttcacggtttgattttaattttttcaaaatccggacatgttttgctttacgataatagttacgtgatttttgcataattattttgaagcttttttcccttctttgagtttaagaatttcatcttgataagaaattccttttcctgaataagcatttggtttgcgcacttgtcgaatttgggcagcaaactgaccgactttttgtttgtcgatccctttgattaaaatagtggttggatttggaactaaaacatcaagttcttgcggaattctgatctcaacaggatgagaataaccgactaaaagttcaattaaattttcttttagacttactttataaccaacccctttgatttttaattctttctgaaatcctttagagaccccgattatcatcgcagataaatgcgaatttgtagtcccatgtagttgttttatttgttttgtttcagaatttcttgttgtttttagactttgattttcaagtaaaattgttatttcctttgcaaattgtctttcgaggatacctaaaggtccttgaactttgacagatgatccttgaatttcaattctaacttgttcaggaactttcaaaatacgattaccgactcgtgacataattttttaccaaatataggcgataatttcaccacctacattttcctttcttgcttgtgaatcagttagaagaccttttgaagtcgaaagaattgcaattccaaaacctgattgaacaaaaggaatttttgatgcacttgtataaacccgcaaagaaggtttggaaattcttttaagaccagaaatggaagaaagatttcctttgtatttaagctcaacagtgatattttttttaagatcaccttcaacttgaaaatccttaatataaccagctttttggataatttctaaaatttttacttttgtttttgaatgctgaaatgaaacatttttatgttttctaattgttgcgttccgaattcgggtgagcatatcagcaattggatctgttataaaagccataatttttaccaactcgctttcttaattccaggaattcgtccttggtgcgctaaaactcgaaaacaaatccggcaaattcgaaattttcttagaactgaatgagaacggccacataactgacaacgagtataggcgcgaactttgaatttgggagcccgatttgctttaacttttcaggatgtttttgccatatttttcctttttttttatttaaaattagtaattttatgctaaaaattatacttttttagcaaaagggaaacctaataattctagtaatttaaaaccttcttgatcattttttgcacttgtaacaattattacatcaagtccccgaattttgctgattttatcaaaagtaatctcaggaaaaacgattgattctttaaatccaagggcaaaatttccatttccatcaaaagatttcggggaaagtccacggaaatcacgaacccttggaattgcaatgtgcagaacttttgctaaaaagtttcacatctgctgtcttcttaaagtgactttaccacccattggcattccttggcgtaattttcaagttgccaaggatttttttgctacagttttataggctttttggccggtgatttttgctagatcttcaagaacagcttcaatcgctttggcattacttgactggtttccggcggtcatattgacgacaactttagtaatttttggcacttgcgaaggcgatttgaagttaaaatgtgcttttaattgaccaaaaaccttttcataataatgtttttcaagttctatcataacctaaattgcctttccggttttttttgcaatgcggatttttttcttattttcaatcttaaaaccaactcgggtaggaattgcgggcttatcttttgttgcttttttggcaactaaagccaattttgaaagcaaaattggggcttcaaaagtgataatttcgccacttgtatttttatttgaaggttttctgtgttttgttttgatattaactcctttaacaatcgctgctttttttgctgggattagttctaagaccgcgccttgctttcctttatcatcaccagataaaaccacaactgtatcatttttacgaatttttcccatttttttataaaacctcctgcgctaatgaagctattttaagataacctttttcccgaatttcccgggcaatcggaccaaaaacccttgttccccggggagttccgtcctcttttatgatcaccacagcattatcatcaaattttatatgagttccattttttcttctaagtccataagttgaccgaacaattaaagctttgactacttgaccttctttgagcattccgttaggaattgcttttttaacagaaactacaacaatatcaccaatatttgaagttttttttaccgaaccacctagattgcgaattacacccacgatttttgcaccggtattatcggcaacattaaggcgcgaaagttcttgtagcattctagatttctccttttttctgtaagacttcgactaaacggaagtgttttgtctttgaaattggccgacattcggcaattttgacaaaatcacctacttctgccaggtttttttcatcgtgagtgttaaattttttgcgctttttaaacctttttgcataaagtttatgtttgtaggcggtttcaacttcaaccataattgtttttggggaggttctaatgacaattccttgtaaagttttccgaagatttcgggtttgagcttttttttctaaagttaaattattcattttcagcactcatttcttgctttttaactagatttttttgaatttttgggactaaaagtggttttagttcatctctaaaatgggacttaagtgattttggctttaccaaagaggaaatttttcccacctttttcgctttttttcttggttttttcagctttggtacttcttcaagttttctttgggaaataattgttaaaactctggcaatcattttccgcatctcgccaattttatgactttgatctaaatttgagctttgatttttaaaacgtaaggtgaataactcggaacgatattcaagaagtaatgaatttaattcgcttgctgttttttttaaaagttctttaaattccataattttcctaaactgttgctacaatttttcatttaagcggtaatttatgtccgccaagtcgtaaggcatcccgggcaatttcatcttttacccctctgacttcaaataaaatcgtatttcttttaaccacagcgactcaacgatcaaccgaaccttttcccgaacccattctgaccccaatcggttttgaagttagtgctaaatgcgggaaaacccgaataataacttgcccttcacgacccatccttctagtaattgcgatccgagcagcttcaatttgggcagctgaaacccaagccgatccagtagcttgaagaccataatcaccaaaagcaacaaaattaccagaatgcgcatcgcgtttgtcatgataaagtcgaaaagttttgcggtgttttgtttttttgggttgtagcatttctatctccttttatcagctcgtataattgcatcaatatcagttttttctttgatttctccaagtgaaactcaaacctttacccctagaatcccgtaagtagttttggcgattgcagttgcatattcaacattttgccttaaagtatgtaatttcatttcaccttcagcatatccttcacagcgagccatttcaactccattgagtcggccacagacaatcgttttcacaccggttgccccgttttttagggcagttcgaattgcaaatttttgggcaattcgataggatttacgctgctcgagtttttcggcaattaattctgccattaattttgcatttaattccggactttggatatcaactgcatcaacatttataacaattttgcgattttttagagtttttcttaatttttcaactatttttttcagattttcgcctgaagcaccaagaaaagaacctaattttgctgtataaacaagtacagtgattgcattatttcggtcacggcgaatcaccgtatttccaatttgatattcacgggtcaacttttcaaaaaagcggtggattttgacatcttctaataaatttatcgaaaatttatttttatctgcataccaaattgcattatgatttcttgtgattccaaaacgaaaaccgtttggattgactttttgtcccattatttaacctctttttcttgcgctaaaaccgtgtttgtggcatcgtttttagtattattatccgctaaatcagtttttttggcggttgtaatactatttgtttttgctgataattgggaatcaaccccattttcggggtcattttggggttgttcagcctggctttgctgggagagcgccccactttgggtattttccggggattttgaaactagatttttttctgtttcttgatattcttgattttgactttctccgccgttttgactggctaaaataactttaaaatgggatgttctttttaaaatttggctcgctgcccctttagcgcggggacgaaaacgctttaaagttggaccctcattgacaattgcagccttgataattaagtttgaatgttcaaaaccgtggttgttaatcgcatttgcaactgctgaattaatcaattttgtaaaaatgggtgaagccttttttttggtatgactaagaattgctagggcatcagaaacttttttccccttgagtaaaaccgccacaaggcgggctttgaatgcggaaattcgctgtgttttgagtgaagcgactgctaaattatgattttctaccttcatttatttaccttttttatttttttgccttatcttttccatgcccgtgataagttcttgttggggaaaactcacctaacttgtgaccaaccatatcatcagttacataaacctcgttaaaaatttttccattatgaaccaaaaaagttagtccaacaaactggggaaaaatagttgacctacgagatcaagtcttaattggttttcttgagtttttcgcaattgcttcatcgacttttttcaaaagatgatcatcagcaaaaggtcctttttttagtgaacgagccattattttttagtttcctttcttgagcggattatcaatttagttgaaggttttttcgggtttcttgtcttaactccaagtgcttttttcccccatggagtcagcggtgattttcttccaattggctgttttccttcaccacctccatgagggtgatcgttagggttcataaccgaaccgcgaactgtcggtcttattcctttatggcgatttcttccggctttcccgatattaacaagtgaattttcttcattaccgacaacgccaattgttgcccggcaagttgctaaaatccgacggtattctccggattttagctttaaaattacgtattttccgttctcatcgcgaccttgaatttgggctcaagttcctgctgagcgaattagttttgctcccgcacccggttttaactcgatattatgaacaaaagttccttccggaattttagccagtggaagtgcatttcccactaaaatatcagatttgggtcctgaacttattttttggcccactttgaggttttttggagctaaaatataacgtttttccccgtcaatataggaaattagggcaatatttgctgacctatttggatcatattcgattgttttaacaattccagtaatatcatccttgtttcttttaaaatcaattaagcgatattttcttttatgtcttccgccttgatgacgaactgtaatttttccttgcgaatttcgacctgaatgtttttttagaattgtaagcagcgatttttcgggcttatttgttgttaaatttgccccaaaatcaagcgaagacatatgacggcggccgtttgttgtcggtttataatacttaagtgccattatttgtttctcctttctgaagatttttttgtctttatttttccgagcgctaaactagacatttttttggtcttttttagtttttgtgttttcttttctttgaaatattttccggctcggccttaattagcactattttcctggttttcggtttgattttcaatccttttttcttgattttcgttagtttcagaatctttttttgctaattcggcttgttttttagctaatttctctgcaatctctttgtttttagcctctaattcggcttttttcttggcaatttttgctttttcttcagtattttcgcttacagtttcagaatctttttgatcttgaggactttcgtcttcaaaaagattaattgtataaccgggcatcaattttacaagcgcctttttatatttggtagtaaacccttttgattttcctagttttttttctttttttgggacagtaaaaatatttaccttttcaacttttacattaaaaatgtattcaactgctttttttgtctcagaacggttagtttttggactaactttaaaagaataaacgccactagacattaattgataagatttttcagttaaaattggaccttttattatttcatttacattcattttttagattctcttctccaaattagtaatttcatttttggaaattattaacaaatcggccttaattagtgattcaactgttagcgaattcgtttttaccagctcaacatttggtaggtttcgtgccgataaaaacaaattcggatcactagaagcgattaaaatgtgacgaagttggtcaattttaaaaatttttaattgatcaactagtaattttgttgaaattttattcattgaaaaatcatttacaagaatttgttgattttgagctagttgggaaagcgctgaaataaaagctaatttttttacttttttatttacttttaaattataatttctttgggtagttggcccaaaagcccgaccaccacctacgaaaattggtgatcttttagatccagctctcgcctttcctgtcgatttttgctttcagggtttttttccggttccagaaacttcagcgcggttttttactttatgagtagagagtctttttgaggccctttctgataaaatcgagtcaaaaattgcttgaaaatgtggttctttttgctcaaataatgacttgggtaagtcatcattagcattaaatttaactaaattttcagttttctgactttgaatgctaatttctgaaattttattcattttttacctctttatccgaatttggcacaaaaagactaactggattttttggattaggtttttttatcgctgattttatcactaaaaaagatttttttggaccaggaactgaaccttttaagactaataagttattttccttatcaacttttataatttctaatgattgttttgtaactttttcatgtcctaaacgccctggcattgtcatccctttaacaactttattaccagagatatctccaagcgatccagtttgacgaatcggttttgatccacctccacccccatgggatctaggtccgattgcttggttatatcgcttaattgttccggcaaacccttttccctttgaagttccggttacatcaacaaattcaccaggactaaaaattgagacatcaacagtttggcctaatttataaccttgaaaatcacggaattccttgataaatcgctttggctttgtatttgcttttgcaaaatgaccaatttctggctttaaaaaacgggactgttttttatcaaaagctgcaagttgaatcgcatcataactatttttttcttttgtaataattttagttacaatattttcaggaacctcaattatacttacaggaattgcaattccttctgttgtaaaaagttggctcattccaaccttttttcctagaattcctttcattttagcttacctcgatttctattcaaaccccagcaggaagttgtgatcttgaaattttttctgttactagtttttgatttgtaggtaaaactttcaaaattacaagtcttttgtgtgttcgactttcaaattgctcacgtgattttttattaatatgcactgatctaagaattgtataaattgctcttgaagtcggtagaggcaccggcccccgagtttctatattaagttcgcgagctagaagaataatttttttagccgcagcatcgatttgacgatgatcaaatgattttaacttaattttaattgatgttgtattcataaaaatatagttgagttgctcctgttcataaattttgaacgaactccacataaaaaccaatacacgataacaactcactctcgcgtactgcaaccttatgcatcatcatcctttaacggtaagattaaattatacacaaaaaataaaaattcaataatttttttaaaaaatttttttacccttagcagctaaaactagtaagtttgaaaagtctgaatattattactatttttccaaatttttaaaaaaaaaaaaaaaaaaaaaaaaattctctaaaaatgattaaaggtattgtaaaaattccaaagaagaggttcttaaagtcatttatttatattatacaggaaaatatttagttgatcaagaccagaaaagtataaaatctgagataaaaaacgtgattgtcagcttaatatcaaaggtaaatatccaaaaactagaaaaaaataatgccacagtaagcaaaaatccagtggttttgcaagctaaattaaaatccaaaacttgttaataacaaccaagttttggattttttgttgtataataatatcaaaattatttataatttattattggtgattttatatgaaagctaatttttctttcttttttaattcgatttttcggagaaaattacaaaaacgctcaattttagcgcttattttttgactaatttttttaataataattgctgttgtaattattgttgttcaaaaaaaagcttgatatgatgcaatctccatttgtgggcttttagccatctcgctttctgcccttggcagcgttcttagacttggattgtttagtagtttttcggtttcttatcataaatgaagaattaattcccagaataaaattttagaaaaacggggatttaaaacagaaactccaaaaattgactatgcttttattaaaaaaaaacagaaagaactctcacttttacctatttttttaggatttatttttggatttttacttttaattattagtcttccttttttaattcaaaattaataaaaaaatatagaagaaaatttcctagtaaagttctaaaattattaaaaaaacagcattaaaaactgctgtttttttaataatcctaattttaatattggattatttatttaaattgttcaaatttttttatactaaaataaattataaaagaagactgattagaaatttagaactattcaaatctttcaaaaaagtggcctaaaaacaatgataaaaaaatttccaaacttttttgttgcaaaaaaaaaaaaaaaaagtataattttaattgtacaagttaaataaatttttcacttatctttttttattttgcaaaacttttaaaaaaattagatatctaaattatattatatgattgagaaaatgaaaaatttatttcctagaaccaagataattgaggtttaaaatatgagtaaaaaatcaaaaacatttaaaattggtttgactgccggaattgttggtcttggagtttttggcctaactgtcggacttagcagcttggcaaaatacagatcagaaagcccacgaaagattgcaaatgattttgccgcaaaagtttcaacattagcttttagtccttatgcttttgagactgattctgattataaaatagtcaaaaggtgactagttgattctaataacaatattagaaataaagaaaaagttattgattccttttccttttttactaaaaacggtgatcagttagaaaaaattaattttcaagatcctgaatataccaaagcgaaaataacttttgagattcttgaaattatccctgatgatgtcaatcaaaattttaaggtaaaatttcaggcattacaaaaacttcataatggtgatattgccaaatctgatatttatgagcaaacagttgcttttgccaaacagtcaaatcttttagttgccgaatttaatttttcgcttaaaaaaattaccgaaaaattaaatcaacaaattgaaaatttatcaacaaaaattacaaattttgctgatgaaaaaacaagcagccaaaaagatccctcaactctaagagctattgatttccaatacgatttaaatacagcgcgaaatgctgaggatttagatataaagcttgctaattattttccagtacttaaaaatttaataaacagactaaataatgctcctgagaataaattacctaataatttaggtaatatttttgaatttagctttgcaaaagatagttcaactaatcaatatgtaagtatccagaaccaaattccttcgctgtttttaaaagcagatcttagtcaaagtgcccgtgaaattttagctagcccagatgaagttcagccagttattaacattttaagattaatgaaaaaagataattcttcttattttctaaattttgaggattttgttaataatttaacactgaaaaatatgcaaaaagaagatttaaatgcaaagggtcaaaatctttctgcctatgaatttctagcagatattaaatctggatttttccctggagacaagagatccagtcataccaaggcagaaattagtaatcttttaaataaaaaagaaaatatttatgactttggtaaatacaatggaaaattcaacgaccgtcttaactcgccaaatttagaatatagcctagatgcagcaagcgcaagtcttgataaaaaagataaatcaataattttaattccctaccgccttgaaattaaagataaattttttgccgatgatttatatccagatacaaaagataatattcttgtaaaagaagggattcttaaattaactggatttaaaaaaggtccaaaaattgatctccctaatatcaatcagcaaatttttaaaaccgaatatttaccattttttgaaaaaggtaaagaagaacaagcaaaattagactatggtaatatcttaaatccatataatactcaacttgccaaagttgaagttgaagctctttttaaagggaataaaaaccaagaaatctatcaagcacttgatggaaattatgcctatgaattcggggcctttaaatccgtgcttaattcctgaacaggaaaaattcagcatcctgaaaaagctgatatccaaagatttacaagacatttagaacaagttaaattgggttctaattcagttttaaatcaaccacaaacaacaaaagaacaagtaatttcaagtcttaaaagtaataacttttttaaaaatggacatcaagttgctagttatttccaggatttactcaccaaggacaaattaacagttctagagactctttatgatctagcaaaaaaatggggactagaaactaacagggcgcaattcccgaaagaggttttccaatatacaaaagatatttttgcagaagcagataaattaaaatttttggaagggaaaaaaaaggatccttacaatcagataaaagaaattcaccaactttcctttaatattttagctcgtaatgatgtaataaaatctgatggattttacggagttttattattgccccaaagtgtaaaaactgaattagaaggcaaaaatgaggcgcaaatttttgaagctcttaaaaaatattctttaattgagaactcggcttttaaaactactattttagataaaaatctacttgaagggactgattttaaaaccttcggtgattttttaaaagcatttttccttaaagcagcccaatttaataattttgctccttgagcaaaattagacgataatcttcagtattcatttgaagctatcaaaaaaggggaaactacaaaagaaggtaaaagagaagaagtagataaaaaagttaaagaattagataataaaataaaaggtatattacctcagcccccagcagctaaacctgaagcggctaaaccagtagcagcaaaacctgaagcagctaaacctgaaacaacaaaaccagtagcagctaaacctgaagcagcaaaaccagtagcagcaaaaccagtagcagcaaaaccagttgctactaatactaatactaatactggcttttcacttacaaataaaccaaaagaagactatttcccaatggcttttagttataaattagaatatactgacgaaaataaattaagcctaaaaacaccggaaattaatgtatttttagaactagttcatcaaagcgagtatgaagaacaaaaaataataaaggaactagataaaactgttttaaatcttcaatatcaattccaggaagtcaaggtaactagtgaacaatatcagaaacttagccacccaatgatgaccgagggatctcctaatcaaggtaaaaaagccgaaggcgctcctaaccaaggcaaaaaagccgaaggcgcacctagtcaagggaaaaaagccgaaggcgctcctaaccaaggcaaaaaagccgaaggcgcacctagtcaagggaaaaaagcagagggtgcttctaatcaacaaagcacaactaccgaattaactaattaccttcctgaattaggtaaaaaaattgacgaaatcattaaaaaacaaggtaaaaattggaaaacagaggttgaactaatcgaggataatatcgctggagatgctaaattgctatactttgtcctaagggatgattcaaaatccggtgatcctaaaaaatcaagtctaaaagttaaaataacagtaaaacaaagtaataataatcaggaattaaaatctaaataaaacccggaggtatttatcctatgaagttagcaaaattacttaaaaaacctttttgattaataacaacaattgccggaattagtcttagtttatcagccgctgttggtatagttgtcggaattaattcttataataaatcatattattcttatctaaatcagatcccaagtcagctaaaagtaacaaaaaatgctaaaattagtcaggaaaaatttgattcaattgttttaaatcttaaaattaaagataattttaaaaaatgatcggcaaaaacagttttaactgctgccaaaagcgatctttatcgttataatcttgtttctgcttttgatttaagtgaactaataaacaatgattattcagttagttttgatttagaaaatgcagtagttgatcaaaattcaattaaaaatgttgttatttatgcaaaatctgataaggatcaaataacttattcaaaacaaattgtacttaaaggctttggaaatacagaacaagctagaactaattttgattttagccaaattgattcaagcaagtcttttgttgatctttcaagggcaaatctaactttgatggaattccaaattttacttgcccaaaattttgaaaatgaaagaggaagtaattgattttcacgacttgaaagagccttggttgcatcaaaagcgagtctttcactttataattccttaggagaacccgtatttttaggtccagattatcaattagacccagttttggatcgaaaaaaattattaactttgttaaataaagatggaaaattagttcttggacttaatttagtgcaaatttcaactaaaaaaactatgaatttaaatcttgaagttcgcggcgcgatttcaaatcaggaaatttctaaaattctaaaatcctgacttgaaacaaatcttcaaggcaaattaaaaaccaaagatgatttgcaaatggcactagtaaaagataaaattagcctctctgattattgatatggatctccaaattcaaaagcaaatacatcccaaattttaacaaaaagtaaagaatttaaagatctttttgatttaagtgagacaaatttttttcttaataccaaaatcggaactgtctatttaagtattattcccaaacttttagatccaagtcagatctctgttgttgataagaaaaaactagttgaaaatcaaaaaattcgctttgaaattactgcttctttaaaacgaaaagctattgataaaaaatttatcatccaggatcttccagtttttgttgatctaaaagttgattttaataaataccaagccgctgttgcccaaatgtttggaacgataaaagcagttaaagaattttcaatgcctgaagatcaagatgcaaaaactttatcctcaaatgaaataaaacagcgagttgatcgtctttttgaactagcaaaaacagtgactaatttggaaaatccaagtgaagaagttcttaaaagcatttatttattaaatacgggaaaatatttagttgaccaagaccaggaaaaagtaaaacaagagctaaaaaccgtgattgagggcttaaaatcaaaggcaaatactcaaaaaacagaaaaaaatagccccacacaaccgaaaaaaccagaggtttcactagctaaaacaacagaaaattcagcaaaaacagtcaaggtaagcacttttgcagaagaagctaagggacaaagtcaaagtcagcaaacacaaccagtttccacttcatcccctcaaactagtcaaaatttgaattctaattccacaaccagtacgaatttagccttagaaaatgaaaaatttgggacaagcatttgaacagcttttaatttcgctaatatttataatcttgaaaatacaaaaagcgaatatgagatctcaactttaggaaataagctattttttgattttaaattagttgataaaactaatcaaaatctaattttggcccagtccaaaattagtcttaataatattattaattctaataaatctgcctatgatataattaagaaattcaatcccgatgtatttctagatggaacaattaattatcaagatcaaggaaaagataaaaaagaatttatcctaaaagatttaagtgataataaattaatatttaaatcagaagatgcaattcaaactgatcaaggtttagagctaaggaaacctttgaaattacagtcaaaaccgtctaatccagaaaaagaaatatcaacttctttatataccggagcaatttatttagtttttgatgcaaaaaatatttctgatggtaattggattaatcttttagccgatagaaaaggaaaaggacttgtaattaaagttaaaaattcagataataacatacctaaaaccaaagaaattgttgaaaatggtacttatttatatgaaattcttgctggtaaggattcaattaaggtaaattcttatttttttccaacaaagtacccaaaacgtgtaaaacgtcttaatttcaagattaaccctaaagacaccttgccaaatttctttactttagaatgatttcatcttgattggtatcaaatcggcccaggcgaacaaaataaaaaaccacaacaaaacgctaaaaaagaacctacaattatattaaaaacgctggcaatatttaatgataaatcatttgcagagaaaggaagtttaacaaaaagaagtgaattaattaacgggttgattagaaactatgttaaaaagtaacgatcaaatttttgttaaaaaacagaatttagtaaaaattccagtttaaaaaataaattaaaattaaaaaaagtacaataaaaacaaagaagaattaatctccaaaaacttatttggagattttttatttaaattataaaaagcaaaccctaattaaaagtggaaaaaattaggaaaaagaagctatttttacttttttttgattattttataattttttgataatattggtgatatattattaaatctattttttcgttgaaaaaggatgtttaataatgcaaatttttataaaaatttgcatttctagccaaaattaatcttttatacattttgttaaaagaaaaattgctgctgtctccgatctaagaattcttttcccgagtgtgatactttgaaaccctaatttttctgcttgttggatttcaacatcatcaaacccaccttcaggcccaatgattataattgtattttgggggttatcagggatatttatattattttttgctctttcaaaactgattaattttactggaaaatttttggcttgttctaaaagatccttataatttataggtaaatttattttcgggatcaaattgcggaaactttgttgggcgctatgaagacaaatttgttctcatcttttgagttttttttcaagatctccgcttattttttgggaaacatttttactataaaaaggtcaaatttcactaaccccaatttcaacagctttctggattgcaaattcaaatgattttgtcttcaaaattgcaagcgcgagaacaactttgttttttggttcgttattccccttaattttttcaattatttctgctttgtttgaattaggcactaatctcacaaggtagaattcattttgataaacacaaataaaattttcatttctaattcttacagttttaatatggtttaaggttatatttgttaagataaagaaattttcttgtttttcattgacaaaaaagcgatacataataaaaattttaaaggaaaattgataaactatttaaaaaatagtttaaaattattaaaaaagaaggaaaaactatggaaaaattatcagcaaacaaaataagacaactttgaattgatttttttcgcgaaagaaatcatttttttatcgaatcaaaaccacttgttccccaaaatgatgactcacttctttgaataaattcaggagttgccactttaaaagattattttactggcaaaaaaattcccccatcaaaacgacttgtaaactcccaaaaagccttaagaacaaatgacattgaaaatgttggtctaacctcgcgccatcacaccttatttgaaatgcttgggaatttttcaattggtgactattttaaaacagaagcaattgactatgcttatgaatttttaactaaaaagttaaaattagatcccaaaaatttgtttattacttattatgatggtgatgatataacttttgaaaaatgaaaaagtttgggattttctaatgaaaaattaataaaaggtagcagaaaaacaaatttttgggatttaggtcaggggccttgtggtccttgtagtgaaatttattttgaccgcgggccaaaatttgatagtcgagggagcgaactaatcaaaaatgagattgaaaatgaccgttttattgaaatctgaaatatagttttttctgaatttaacaatgatggccagcaaaattatacaccattaaaatcaaaaaatattgataccggagctggctttgaacggattgtttcgattttacaagatggcccaactaattatgataccgatctttttctaccaattattgctgaaattgagaaaaacactgtttttcgatacaaaattgagaactattttctaaaagaacctcgacaaacacaaattaataaaagttttcgcataattgccgatcatattagagcaataactttagcaataaatgacggggttcaaccttcaaatttacaccggggatatatcattcgccgcttgattcgtcgagcatattggaatggaaaagaattaggaattagtcacccttttctttataaattagtggaaattgttggcaaaactttagattatcgttttgatattccaacaattagcaaaattattctcaatgaagaagaaaattttgcaaaaaccttggaaatagggtataatttacttgaaagtcaactaaaaattaacaaaaatcagataaaacctgtgactgtgttcaaactttttgaaacttatggttttccggttgaactaacaaaggaaattcttgctgaaaagaacattgattttgatcttagtcaattagtggaatttcaagaaaaacattcacagatttcaagggcaaaaaaaactactgggatgcaaaaagtgattaattcactaactcaaattaaagctaaaatttcggattttattggttatcatactcatcatattgagaccaaaattagctttttagcgaataaagacgaagaagtagctgaaacaaacggtgaaaatttatcttatgtaatttttgaaaaaactcctttttatgcaacagccggtggtcaaaaacatgatcaaggctgaattattcaaaataattcaacaattgaaattcttgatgtttttaaagataaatttttaaataatattcatgtctttaaagggaaaattgttaaaaatcagccggtttttcttaaattagatacaaaaaaccggctgaatttagagagaaaccattcaggcacccaccttttatttgcctcacttagacaagaatttggctctgagattaaacagttaggatctgataataatgaagatcgcctaactttcgattttccacttaatcgaaaaccaagtgatcaagaaataaaatcggttgaaaatcgcataaattcttacataaatcagaaaattaaacggaaatacctagttacaaatcttgaagaggcccaaaaactcaatgcaattatgacactggaagaatcagaatatatggacccaaattcgttacggttggtgatttttgataaaatcacaactgatttatgtgggggaactcatattgaaaatacagaattacttgaaaaatttacaattttaagctgccaaagcaaagggtcgggaatttatcgaatcagagcagttacttcctggaataaatattttgagtttttgaaaggaaaaattcaggaaattttaagtaaaatttccgcattgaaaaacaaaattaagaaaattgagcctaattttggcctaaatttaccaaatttagttgatttagagcaacaatttgattacctaaaaaaaatagaagatgatctaagaatttattataaaaaacttctaaaatcacaattaagaatagcaaaatcggaacttgatgcaaataaaataattgaaattggcaaatttagtttttatttagattttaaccttccactgcataatttaaagcaaatagccgccacctgaagagaacaaaatccaagaatatcctttattttaggtgctaatttagttaataatgaatttttaatcattgtttcttctgcaattttagcttctaatcaaattcttgaaaaaatttttgaaatttttactggctcaggaggtggaaattataagattgcccagggaaaaattcaaaaaaaaccagaaaaagaggtgttcattaaacttttatgggaaaatataaccgaattttagcacttgatcttggcatcaaaacttgtggatttgcaatttctgatcaaaactgaaaaatttcctatccacttgaacagtttaattttaatcgttatgattttgccagtgtaatttcccgaattgcattttgaatgaaggaatatccaatttcaatcttagttctaggttatcctttaaccttagctggtaaaatttccccgcggacaaaaatggttgaatactttgctgatttagtaaaaaaaaactatgaaattaaagtggtttttcaagatgagcggctgactacaaaacaagctcaaacttttttattagatttaggaatttcctttaaaaaacggcaaaaagtaattgataaattagccgctcagataatattagaaagatttttaaatacaaaaaaaggataaaaaaaatggataaaaccgacaacaaaccagaaattaacctatccgatgaagctcgtttaatcataaaacataacaagctcaagggaaaacaacccgtctatgagaaattttatttaattttttataaagaattagaaaataaacgtcttttttctgtgatgtttgatgaagaaagaaatattttagtctttgaagttgatagtaaaaccttagttcctattaagccaatttctgaattagatcaagaaattcatcaaattattgagaaggagattcgaggattttttaaagaccattattttacttttgagggccaaagaatttttcctgaaattttttttaataattttgatcctatttccgaatttgatgatataataaattttttgcgtgatgatgaagtaattagccttccaatttgactccaaaaataaaaaaataatataaaaacaaaggtaaatttagaaatgaaactaattgtcggccttggtaatcccggggagaaatatgctaaaaccaaacataatgtcggctattgagttctcgatttactagcggaaaaattagctcttagttttgatcagaaaaccgaaaatggaatttatgtaaaacagcccgattttattctagcaaaaccgacaacttttatgaataagtccggcgattttgtcgaggaattaattaaattttataaaattaatactcaagatttaatgattatctatgatgatatgaattttgaggtcggccaggcagcaatcaaaacaaccggcagtgccggtggtcaacgcggtatggcccatattatcgaaaaatgcaaaacaaaagaaattaaaaggctaaaaattggtatttctcggggcgaaaatgcaaaagaatatgttttatcaccctttttacctaaagataatgcaaaaattaaacttgtaattgaagaagcagctaatattctgattttttatttatctaatagttttattacaacaatcgaaaaatttaatgcaaataaaaataaagtctaaagaaaaatatttaataggtgtctcaggtggctctgattcaatgtttttgctcaataaatataaaaatcaggatgtaattgtagctcatataaattacaatttgcgccctgaagcaatttttgagacacttttggtttcaaaattttgtcaaaaatacaatttagagctgaaaattctatcatttgatagttttaagattaaaaaaaatttacaaagcgggcttaggttgggccgttatcaattttttgaaaaaatttataaagaatttaattgtactaaattattggttggtcaccaccgtgatgattttcttgagacagtttttttgcagaaaaaacagaaaaaaattgtcactttttgaggaatacataaaaaaaataacctttttaatatggagattttgcgtccttttttgtattggagaacaaaaaaacaaattattcaaatttgtcaacaaaaaaaaattccctatcttgatgatcaatcaaattttacgggcaaatatcaacgtaatcaaatcaggtttttattggaaaagaagagtgatttttcacttttttttctttttttattttattatttaataaacatatttaaattaataatattaaaaaatcagaaaaaaattttgcaaaattgacagaaaacagggtataatataaatttctttaagaagataaaaattaagtcaaaaattatttttttatttgttaatcaaaattttgataatgttaaattaactagggggaaaattaacgaaattattaattttatttgcgggaaatcgactagtggggcttttttactaaaaaaaaacaattatattataaaaaaaaagtgaaaaatattgccaaaatctagtaaaatttagtaataatttgtattttatttataaactggagggtaaattatggcagcgaaaacaagaaaaaaaccttcaattggcctgataatttttttagtaattactttgtcaatagtaggttatataatttatcaatatttgcagccgcaacttaaggttgtaaatctttctttttttgaacgtagattaatcgaaaatgctcaaagtgcaactgataaaaactttttttatgctgttattttcgatattaatgactacagaattaaggttgttgattccgttaatggcgaattagatgcctatacagtcattgctaatccccatgtgattggtaaatttcaggcaggaaatgcactaattagcccggcaattaaaaatcaactcgaaaataccaatattacaacttattctgagttagtctcacttgcaattaaaactagcccatcaagttatactggcctttcacttgaaaaaatcagcgcgcttaataaattattagatctcgcaggtggagaacgctattcaaaaagttttctcccttcaattgcttcagctgaccgcccatatccttcactttttcaaattattctctcatatcttccagtcgcagttaccatttttgtattcctttattttgttttcagggttaatcgtggatctcaagggggggccggattttttaatcctggtaaaaaccaagcaataagaattaaatccgataaaaaatacactgatgttgccggaaatgttgaggcaaaagaagaaattgccgaatttatcgactatttaaaaaatccaacaaaatatgctgctgctggtgcaaaaatcccgcgcgggattttattaggcggcccaccgggaacaggaaaaactttattagcaaaagcaactgctggtgaagcgaatgttccatttttctttatttcggcatcaaattttgttgaattatatgtcggagttggtgctaaaagagtccgtgaattattcaaagatgcccgaaatgactcccctgcaataatttttattgacgaacttgatgcgattggccgttcccgtgggtcaggaatcggtggcggaaatgatgaaagggaacaaactttaaaccaacttttagtcgaaatggatggaatggtggaaaattccggacttttggtaattgcagcaacaaatcgaaccgatgttcttgatccagcacttttacgtccgggaagattcgatcgatcaataattgttaatctacccgatataaaagaacgcgaagcaattttaaaattacatgcaaaaggtaaaagaatctccaaaaatattactttggcaaacatagccaaacgaacaccaggattttctggggcccaactggcaaatgtgatcaatgaagcaactttactttcagttcgtgagcagactcaagtgataacaaacgaacaaattgatgaggcaatcgatcgggtaatcggtggcccagccaaaaaaaaccgggttataactgaaaaagaaagaattatggttgcctaccatgaagctggccatgccgtagtgggacttaaattaaaatcaggggtaaaagtccagaaaattacaattgtacctcgtggaaacagtggtgggtataaccttatgcttccagaagaggaaaagtacaatagtacaaaatcggaacttttagcctcaattgctgcatttatgggtggtcgagctgctgaggaaattaagtatggcaagtcggaaatttcttctggtgcagcaaatgatattgaaaaggcaacaaaaattgcccgaaaaatggtaactgaatgagggatgtcttcacttggcccaattcagtatgaacaggatcaatcatccccatttttagggcgtgattatataaaaaatgcctctttttcctccaaagtcggccatgaaattgacattgaaattcgtcagattatctctgaatcatataaaaaagcttttgcaacaattaatgaaaatttattgcttcttgaattaattaaagatactttattagaaaaagagacaattgtttacgaggaaatccaacaattagccgagacattaatgccgcttccggaagttagtaaaaccgaaaataatgctataaaacccgatgagattcttaatcaaattcttaaatcccaaccagaaactagtccagaaacaggaacagattcaagtcaagaaaatttctaattacaaaaaaactctatttttactaacttttataaattatttttgaaatttgcaaaagttagtaaaaattaaaaagttttttcaaaaaaagctttttaattttattaaggtgatgaaaattatgtcaaaactaaatgatcaacaacaatttcgccgggataagcttaaaaatttagttaaaaatggttttaatttccctagttcaacttttgagcatgataatttagtagaaataaatgaaaaatttagtcaaaaatcgaaggaatttttccttgaaaatcaagtaaaaattgcttttgctggtcgacttattcgccaacgcggcccattttttataatttttagtcaaaacttgcaatttcaagcttatatttcaaaagaatttcaaaaaaaaaatgaatttatctttgcaaatttagatcttggtgatataattgaggtttcaggttatcttttcaagacgcaaactggtcaacttagtattaaagttaataatttttctctgcttacaaagtccttgcaccctttaccagatcagtattatggtattgaaaatccagatgagaaatacaggaaacgttatcttgacctgcttgtaaattcagaatctgcaaaaacttttcgacttagaagtaaaattatctccttaatccgtacattttttgattcccaaggttttttagaagttgatactcccgttttacagccagttttaggcggggcatcagcaaaaccttttattacttattataattctcttagtcaaaatttttatctccgaattgccacggaattaccgctgaaaaaattattagttgccggttttgaccgtgtctatgaaattggtaaaatttttcgtaatgaaggttttgattcaactcataatcccgaattcacctcaattgaattttatcaggcttatgcaaatttagagaaaataatggatcaaaccgaaaatttatttcgttttttatttgaaaaattaaatcttgatccggcaaattttgatttttcaaataaaaaaattaatttcttggaaaaatttgcccgttatgatatgattgagattacttcaaaattaatgaacttcgatttaaaaagtgctaattttgctgatttagtcgaaaaagcaaaaaaagaaggggtgaagatcgagccatttttcaaaaaagggcatctaatcaacaaattttttgaaaaatttgttgaaccaacactaataaatccaacttttatcataggtcatccaattgaaatttccccgctagccaagtcaaatccaaacaatcctaattttactctcagggccgaattatttatctgtggtaaagaatttgcgaatatgtttgatgaattaaatgatccaattgaccaattaagtcgttttcaagcccaaattatcgaaaaaaatcagggaaatcaagaagcaagtgagatcgacaatgaatttgttcaagcacttgaatatggaatgccacccgccgggggttgtggcattggcattgacagattgacaatgcttttaacaaagaatgaatcaatccgtgaggtaattttattcccacagctaaaaccaaaaaaggactaaaatgaaactattttttgcttttgacctggatggaactttattacgttatgataatacaattcatcctgaaaatgtagagattttaaaaaaactctatgaattaggccactttttagctctagccaccggccgaggactttctggctgccttgatttagccaaaaaatatccttattttcattatctagtttcaaataatggaaccttagtccatgatactaaaacccaaaaaaccatcaataatggtagccttagcaaagaaattatctttgatttgatcaaagattgtaaagcaactgattcgatttgtgctttctcgagtcctaataacctttttgaattttcaagtacaaacaatcatccctgactaaaaaaacagaaaataatggacctgcacttctatgaaaaagtagatcaggataaattatatgaaatcatcgaaaaagaggaaattacccaagttgccttccgtaatgatattccagtgattgctgaactttataaaaaatggtcaaaaaaactaaaaaatatctataaagtaacaattacaaaccgtatttttcttgacataaaccctttaaatgttgataaagctaacggaattaagatgctattagaaaaaaataacctaaaacctgaccagttaatcgcttttggtgatagttcaaatgattattttatggtaaaattagctcgttttggttatgcaatggaagattcaacccctgatttgttaagcgttgcttatcaaaaaattggcaattgtaactccggatcaattgccaaaacgataaaatcacttttagaaaaacaagaagagctattttcctaggcaaaattttgaaaaaattgaatcaagaagattttcatcatcaactcggccaaaaatagtttttaattcttttcaggcaattctgagatcaacaattgcaatttcaggaccaaaaccagattctaaactggtttttgcatctagaattgctaattttcctagctcaatttgcgaaatttggaaggaattagcaacaaattctttgttttttcctaaaaaagcaaaaattgacttgattttttcaagtaaattttcaattttttgatattttgcactgattaaaatttcatctttaaattcctcttgattttcaagaagatctgatttattataaattttaagataaatctgatcaggtcgcgtttttgcttttagatctaaattttgcctgtttttttcactagcatcaataatgtgcagaattaaatccgcttttttgatactttcataagatttttcaataccgatttgttcaattttttcagtagtttttctaattccggcggtatcaaaaagtttaaaaagaagaccgtcaaggacaaaatttccctcaacaacatcgcgtgtagtgcctggaatttcgctgataattgccttattttcgttaattaaaatatttaaaagtgaggattttccgctgttgggcgctccgacaagacaagtttttatcccttgataaatcaggcgcgaattatttgcgatttttattaactgatcaaaatcggctaataattggttaattcttggcaaaagcacatctgaggttaaaatttcaacatcatcatattctggatagtcaatatttacttcaattatcccgataatttcctcaattttttcaattaaatttttaataaaattagaactttttcctaaaaattgatttaaagctgcttgatgttgaacttttacctcagcatgtattagatcattaatggcttgggcttttactagatcaattttcccatttaaaaaagcgcggagactaaactcacctggatttgcaaggcgggcgagtttggtttttaaaataagctcaagaattaaatttgtatttagaacaccgccgtgagcattaatttctacagtgtcttcaccgacaaaatttttatttccagcaaatcagagcactaaaacttggtcaattttttggttatcatcatgaattcaaccaaaagttatctccattgaccttccgactttacctaaaaaaattttttccataattttaaaggcattagggccagaaatccgaatgattgaaattgcctggtttatttgcccagaagcgattgcacaaattgtatcagaaagcaacttaaattctcctataaaaaataaaaaatagaaaaaattaaagctaaattcctatttttttctcatattcagccaaattcccttgaaaaaaaattgcactatcttctttgatatctaaaataacattagcaacttcgttgatcaaagcaagattaaaagtggtaaaaattacccctgagtcataaagttttaaagcttcaatgaatgaatcaatcgattcagagtctaaatgattaagtggttggtcaaaaagtaggaaatttgactcgcttaacatcatttttgcgaacatcagacgaactttttcacctccagatgtaactgaaacttttttaaaaacttgatcgccattaaaaaacatccttccaagaaaacctcgcattctctgggtagaattatccttgttttctggttgtaaattaagacttggccattgtgaaattcaggataataaatcaagatcgccgttaaaaaaactatcattatttgctggaagatagtcaaatttgattgtcgaacctcaactgattgttcctgaagttggcatttcttttcctgttaaaatttcaagtaatttagttttaactaaatcatcttcggcaaaaattaccattttttgacctggtaaaagattaaaagaaatattttgaaataaaaaattacctgtaagtggatttttataacttaagttttcaacatttaaaacttgttttcccggccgcgggaaaactccaaaacgaatataaggatattttcgtgaggagggtttaatttcttctaactggattttttcaagtgattttttccgggaagttgcctgggctgattttgaagcatttgctgaaaatttggcaataaatgcttctaatttggcgatttgctcctcttttttagcattagcatttttctggagttcctttagtagttctgatgattgtttccaaaaactgtaatttccggtaaaaatttttatctcgccatagtcaatatcaactgtatgtgtgcaaacttggtctaaaaaatcgctgtcgtggctaacaattagaacaacgtttttataattaattagaaattctttcagtcatttaatcgctttaaaatcaaggtggttggtcggctcatccattattaaaatatcggggttgccaaaaagtgcttttgcaaggagaactttgactttatagccggattttaaatctgacatcttactatttcagtattttttgggaatttcaagagcagagagcaaaatttgggcatcattttccgcgcttcatcctcctaggagcccgaatttttcctcaagttcgccagcgcggttataatctgcttcagttgcatcaggatttgcataaatttgatctttttcttgttggatttggtataatttttggttccccattattacaacatcggtgacattgaattcatcaaactcaaaatgattctgtgatagaacagaaattctttggttttgtgagatatgaatagagcctgaacttggttcaataagtcctgctaaaattttcaaaaaagtggatttcccagcaccatttgcgccgataatgccataagtatttccttctgtaaattttaaatttacattttggaataaagttttatcagcaaagattttcgataattctctaacttctagcattttattttcctttaattctaattttttatggtataatattatacaataaaattgaaaaataactagtttaaattttcatctttttccatttatttattgtctcttattaaatttatcaaaaaagaaagtgaagtttaaaaaatatcgctctttttaattaaaaatcaaaatgttaaaaaaaaaatttagaaaaattttagctttattcttgccagttccacttgtttttttaacttcttattcttgttgaagttcacgaattaaatcaattagatcagcaattaatgaaaattttgggccagattttgaactaccagaaaaacagggagtttttaaaaaacaagatccaagatcatttgatctttatgtatccgaagttaatgcaatgcagttaaaatgatttttaaataagtcaagtttaattgacttatcccaggaagaaaaaaacaaaatttatgcttcaaaactcgcaagatattatgtttttgataacaaaaatcgaatattagcagatgaggataaatttaaggcagagcaggacattaaccctacctttttaaaaaaagtctttgaaaaagcagctaattcttactcaggagacaaaacaaataatcaaggagagtctaataaaaatagttttgagaaactagataattttaaaatttaccgcgagatttcaaaaatttttgattctaactggcgttttcttgaggttagacttataaaaccagggataattgtacctgataaaaaaaattatattttaataaatgcttataagatttattatacaaatcctgttgattttgaaaagaaaaatgaggcagaaaaaactgaaaatactgaaaatcaagcccaaaacaataaaaactggcgaattaaagctccaaatcaaaaaccagtcacgcttttacgacttcattgatataataaaaatttagaaaatccttttaaaattgagtttaattcaattgaaaatccaaattctgaatatgacttacaaatgataaatgatattgaccaacccgagtcaatagctgattttgactttaatttttcaaggataaattctaaaaatacctcagaaccacttgaaattttccattcagaaccatttattcgtctagtttcgcaaagttttgcaatcccttttgatggtgaaattacagattttgaagctgaggattttaaatttaaatacgtgtttaacgaaaaaaattaaattttttataattttatattaaatttactatttttcttcaatataataaaaaaaatttcagatttttccattatggtagaaaaaaacgtaaaaaattataattttttacgttaaaaataaaaaatagcaaaatttttaccaatttttattttttatggtatatttataattagtctttaaaaaacgaaagggtgaagatgcaagcaaaaaacaatttatctcaatttgtgaatatgattttttcttataaaatcaatttttttgcatttttatttttgaatattttttctagatctttctcaattaataaaattaagcaaattttgaataataaatcaattaactgtttgccgttttcgaatctaataattatataatttaaaaaaaatattagatgagaaacgggttaaaaaacccgtttttttattttaaatataaataacgaagaaaggaacaaaatgtctttaaaaaacgaagaaggccagcgtcttgggccaggttctaatatcctaaatttttcggtttcgaaaataaatccaaaaagtatcgattataatctcatttattcagttgtaaaacataaaaaaagtcggttttcttgacttaaatatataaactttgaatcttttgcatttcgattttttaagaaaattactaaaatttttcttgaatttgtaatagtagcttgaatagttgcaactttggttttcttgttaattgattctattcccggagatccaagttttcttgatggactaacagaggcccaaaaaacagcagaaaaacaactttatggactagatttaccacaagcacaacgttattttaattatttatgaaagtttatccattttgattttggaatttcttatagtttaaggccgcgtgttgaaattagtgattttatttggcaaagattttttacctcattttcaattggtattgtctcagttgttcttacaattctaatcggtgttcccctcggaattgctgttggtaaaaatccaggtaaatttttggataattttgcaacaatttggattgcggttttttcatcaattccgtcactagtttttgctttacttttattaatttttggccaaaagactggaattccttatatttttaatattcaggatttttctacttttgtccttccagcgattgcactttcaattggatcggtaattagttatgtccgttatattcggtttgagctaaataatgagctaaattcgatgcatgcaaagtttgcttatctaaaaaatttaacaagaaatcgttttgtttgaactcatgctcttaaagcttcgctttttccaattgcaacttttttcccaattgttgttcttggctcatttattggatcaatttttgttgaaaagatttttttaattaccggttcaggaggtattatgatcgatgcaattcagtcaaaagataataatatcattctttttttggtaatagtttattcacttttgacaataatttcctatactttaagagatataagttatgaattacttgatccgcgaattagaaggagagcaaaataatgacccattttccttcaattgagaaatatattgaccaaaacttaaaaccaaacccatttttacaacctttttcttataaaatgtggaaattgatggttgctcaggccaaaaactttgatcgaaattattttggtaaacctcggaataatttctatgaagtttttttaagattttcacgttcattttccggagtttttggtcttgttactattggatttatgctaattttagcactaattattccatttacaaccggatcgccgacagaattacgtcctaatatgaaaaatattaactattttagtcaaggatttattcttggaactgactcacaaggtcgcgatgtttgggcatttttatggcacgggctgcgtttttcgttaattttaagttttattgttgctctttttgatgtagccttagggactttatttgggaccttaatgggaaattttgatctttttgataaaatttttacttttattattaagataatttctaatatcccaacaatcttagtaattattttgatgactttggttcttcggccaagtttttgagttctaattttgtctttttcacttacagggtgaattggacttgcaaatcaagttcgagcccaaattaaaagagcaagaaattttacttgggtgattgcctctagagttttaggtaccccttcttataaaattctttataattttgtcccggtaattattccgcttttaattacaaatatcgtttttgtaattcctggaacaattcttggtgaaactggacttgcatttattggactttcacttccaaatgttgctactttaggtaatgcaattaatgcgggaattccaattgtaactttatatccccgttatgttttaattcctgcatttttcttaattttacttacctcttcaattcaaatgattggaaattcagttcaggatgccctaaggaggcaaagataaaatgatttcgtatttttattcaaaatcagcaccgcagtgtcttaaaactgaaaatcccagattttgttataaactaaataaaaatttagtaaaatttcaaaaagaattagatctattaaaacagaaaaaacttgcaccaaaagaatatgaaagccagtttagtgatctaaaagaaaaatttttagcttatgaagttaatataaaaaaacattatcaggcaaaaaaatcctataaattacgtgctatttgagatcggattcaaaaatattgacatacaagctttaacagatcccattttgattttgaagcattttctaaaaatgttgaatataaacaaataggaaataaacgtcataaaattgttgcccagatcaaaaatttaaacctttcctttgtcaatccagcaaatcccgagattagaaatatcgtgattcgtaatgcctcaattgatttttatgaaggcgaaattcatgccttaattggcgagtctggttcaggaaaatcagtaattacttcttgtctttatggtcttgtcggtcaaaacggggtaattgaatcaggtgaaatcaaactttttaacaatccagtgcaaaattttgattttcgtgcttgagaactttcaaattatcggggaaaagttatttcagctgtcttccagaatccgatgtcaactttaaatccaacaaaaaaaataggcatccaaattatggaaggaatgttattaaacaagattgttaaaacgaaaaaagaagcctatgaaaaagcacttttatatcttagaatgaccaaaattgctaacccggaaatggttatgaaattatatccccatgagctttcaggaggtatgattcaaagaattgtgatctcagcaattttatcacttgaacctaaaattatcgttatggatgaaccaacaacagctttggatacaaccgtgcaagctttagttcttgatattatccgcgatctccaaaaaagactaaaaattacaattattttcattactcacgaccttggagttgtcgcttctcttgcaacttatatctcaattatgtatgctggtcaagttgtcgaggaaggtacaagagatgaaattcttttaaatccaagacatccatatacttgagggctaattacttcaatgcctgatgtcaataaaggcgaacgacttcagtcaattcgcggggttgttccttcttctttaaattcaattgttggcgatgcttttgcagttagaaacgattatgccttagaacaagatttttttattgaacctaaattttacagaataagtccaactcaccgagtcaaatcagctttacttgatccaaaagcaccaaaagttgtcccaccaaaaattatttaccaaaaatgactgcaatttgcaaagatgaggcaagaaaatggaagataaaaaaagattttacctagaaaaaaatagttatttttttggcaagatagtaaaaaatatttaccgcgcccttacacccggtattgaaaaaatgcttgaatttaaaggcaaatcaccaattgtcagctttcgaaatgttgatattacctatggaagtggttcaagaaaaaacaaagtaattcatgatattagttttaatatttatgaaggtgaagttctatcctttgttggtgaatctggttctggaaaatcaacaacaggttcagcacttgcgggtttagttccccgtagttttggtcaaattgtaattaacggatttgagctaccaaaaaatatccggaaaataaaggcaaaaattcttggaaaactagtctcaaatgtgcaaatgatttttcaagatccattatcttcattaaatccttataaaaatatttatgatgtaattacagaaggtcttgtaaatttagaacaacgccaaaaaggttcaacgaaaattttattttcacaacattattaccaaaatacatttgaatctttagtttctgcccttaaaaagcaaaaaatttctccagaaattatccagcaaattaataataatttctataaaaatacaaaggacattcctgttgaaaatttgtttaaaactctaataaattaccttgaaaaactaagagttatcgagactaaaattattgactatattcaaaaaaagtctttatttttacaggattttttaaaaaaaccactaaaagatattacctataaatatgttattgacatgttagcctctgttggacttgatagctcagttttatcccgttatccacttgaattctcagggggtcaacaacaaagaattggaatttgccgggctttattattaagaccaaaaattcttgttgccgatgaaccaatttcagctcttgatgtttcaattcaagcacaaattattaatatttttaaggatttaaaagaaaaatataacctgacaatcttttttatttcccatgatctacgaatggttgaatatatctctgatcgaattgcggtaatttatcggggaagaattttagaaattgggccttcaaaggaaataattaaaaattttttgcatccttatacaaaatcattaattgaatcaattccaacaattgaatcaaaacgaggatcgcttgctggttatgtctatgatccaaaaatacatcaatatgatgaaaaaaatcaacctcaatgaattaatttaggaaataatcactatattttagcaacttttgccgaactaaaaaggtgaaaattaggagactataattatgaaaaaatctaatattttgcttagttatttattagcaggcggaattcttgctggggcttcagccggaattatgggtggaattaaaatctattcagaaaataatgaactaggtgtctatgatattgatgtccaatcagatgaaaaagttgatattaaagatgatcaactagtctatgcaaattttaaaaatgcccagggccaaacagttgctgcttttgagaatctaaaagatccaaaaacaattttacttgatcctaaagtaaaatctgaaaaaagacggtttaatgaagtcgaatttgccgattggtttgccgataattataatcggcaaacaccaatttttgaactaaaaattggatcaatgcgttttgttaatgaatattgagattcacttttaccttcagaatttatcaaatatgcccaatgatttaacaaaaatgttgcttgaggaccagatgcaattactcttgaacattttgccttaaaaaaaggggttacaagatctgggaataatttattattaggacaacatgcaactgaaagaaaagaagtgacaaaaattgagttctatcctgattcattttttggttcttttccaatttattcagcccttactggaaaaggaaatagcgatgataatctaacttataaaatttttcataatccaatttcaaaagaatcacttgataagtattttgaatcaattccaactcagcaagttttagcaaattatgataaatccaaagtaagtgccggaattccggcaattgatttagtcgaaaatgaagatatttatttttatgatttagtaaaaattcttaaaaaatcttttccacaaaacaaagagattcaagataaattagccaaaattacaaatgaggaaaatttttttgtctttgccgatccaaagcaaaatcttgatcaagtcaagaaaaaatttgaattagcaattctaatgcttgccgatgaaaaggatatccaattaccgcagaattttcaacttattttcccagaagattttacaaaaactcggaaaattaagtgaattcgaagcgcattatctcccttcaatcaacaaataaaacatgatgcaaataatattccccaaggtgtttttttacttaaacttgaagatttaatgtcagaaaatccttctaaacaaccaaaagatcttcaaaatcaagcacaaaaaccaacacaaactagtgatcaaggaaaaaaaccacaagttcagcaaccaaatcaaagccaagctcaaacaaaagatttccgcttttcaataaatcagcaaatgaaagcgaatcgtgttgccctcatagttggggaattaacaacgaaaattcaccaaaaagctgaaaaaattgcaaaagaagggttttttgatctttataatattaatcatcctgttggaaaaataattgcaatttaccaaaatagtccagaaaatcgcttatttttgccagttgattccaaaaatccagccttagaagccgaaaatgaatttataacccaatttgatgcaagtaaattttccacctatgaaataaaaacagcaaaaaaattatcaaattataaattagaaattgaacttgttgaccaaaaagataaaaagtcaattaaaaaaattatttttgaccttgatccaaaaggtaaaaattatcaaagtcaacttgaagaatttagtagttttaaaattgcaattgactggaaaaaccgggcaattccaagagttattcaggaaattgaaactttaaaagacggtaaatcaacaactgtttatcaactttatgctgaagtttttgatggactaattgataaagttctaaaccatcgaaaaactaatggtgaaaaacttgtcggaacttatattatatcagaagttgatccaaaaacaggactaaaaacctatcaaacaaaacaaggtagttttattggatattcccaatcatcccgaattccttatatttcccttttaaaagcctcctcgccattttttaaaactacgggaattaactaccttaaatatgtaggcgctcatgaatatggtcatcaccaaacactaaattatgcccaggatatttccgatccagattcaagtattattcttgatgcgatctcaacaaataccgggattggtttgcaatctttttataatttagatgttctaagaaaatatctccatgcacgttcttcgggtctagacttaagaaaagcagggccgagtttagaagcgcaaaaaaatggaatttatccaaattttacttttaatcgcgataataaatttgaaagtgaagtcgatatttatggatcaaatgaaaatgatgaggttgattcattattaactaataaatctcggcgttttttgcagacaattgatggtctaaaaaccgcggctgacttaagaaagttaaaattatacgatcttttccttttaaattcaattgatccagaatctgcaactattaatccttcaattaaagattcagcaaaattttttagaaatgactggcagacaatcgaggatcaaagtaaaaaaggatttataaattctactgaatccaaaagtttatttggaaattcattaacagatgcagcaggaaacttacttgaatttgatgaaaaaggtaaattaatcgttgccgaatttaaggaatctgaggataaaagaaccttcagtgatcttaaagtaaaagtgttttttgcaaatggaagaccagcaattgattcgacaatttttacaaaaccaaacagccttagtgaattaaaagcaaaaattgctgagattcaaaaagcattttctgataatgttgtttctaacttcgacaataatggctgagatacaaaagccgaaggattctcccgttttcttccttctaatcctttttttgctaaatcacttagtgcaattttagcaaataatgccgaaaaagaagcattttatgggacaaaaattgccgataatccatctaaattagaaattagtgttgaacttcctagttcagtttttgatcctagtcaaattcttagtattgtaaaaaggtatataaaagatgaagaagcaattaaattaggtgaaaaattagttcaagatagtaaaggcaaattagattttcctacttttctttcaattttaaataaagaagaacttactaatggtaattcttcagcaataaccaaattatttgaaaaaatttttctaactccgataacagagaaaaaagatttatataccgatcttagaaatatcacctatttccgtgattctttagttggaaaaattgatttagctgttgaatttattcaaaatatttataatatttattttgaatgactccaaaatcaaagcctcgggataaatcaggccctaaatactccaaaaccaaatactaccccggatagaaaagctcttgttttaaaaagttactgaaactttgtagtttctgaccagatttggaataatttagacaaaatttttattatcaaaggtgaaaaaaatcctgaaaaaataccttctcggtttttttctgcaatccgaaatttccatcgattaacaccgaatgtttatgataaaaattttgttaacttaacacagggggcagttttcgcttcaagtcaccttggaaaattaatttcaattaatggaaatgaatattatcaaaatccaaaatatgactttcttgctacagttacaagtgggggaaaaaattatcttgtccttgatcattcagaatttgatgtaaaaattcgatctttaatgcgaagatgaatttcgccacttgggaatttgcttaaatttgataaggttttacttgaggataaaaatacaaatccgaaattaaatccattttttggaattgctcaggattttaaatttaaaataggtccagatcaaaaaattgatacttcaaaaatttatttagatgcctgggataaaacgctttttggttttgattataataataattattttggatttcaaaatgaacaaaaagaaactgtattttcaagtatttctgattttattgagtttatctcaattgatcctttcgcccttagagtaacaaaaaatggcgaagattttatccgaaattgaagtcttgattatgtaaattctaaatttgatttatatagatatgcttttgataggcttcaaaaagaaaaatttgttctaaaatctagcacaaataatcaacttacctggaaaaaggagctaaaatctacagaaattattggaaaacttttagctaattttgaaattagctctgaaaaattattagaaaatttacaaaaatatgcaaattttctaatggaagctttcgataaatcaacgcttaatttgttacttaaaaattctaaaattgaaaacaaaaatattgatcctttatttttatcttcaattggatttatgggatttaaaaattatgcccgtaaagttgatgaaaattcattaccagcaacaaaatttggtaaattaacaaatcttgatagaattaaaacacctgagacaacttggttgactttttcaactttcctaaaagaaaattcacttgttttcgataatgaagattttgttaatgatgatcttaataattcaaataaatcacttgtatataaatggattttaaatttcttagaggataaaaaaattgaatttaaagatcttgatttatttagattacaatatctagtcggaacaaaaacctttgctgattatacacaggaagatggtcttattaaacaaatccaaagaatggatgtcgatcttggactttcttggctaagatcgaaaaatttagcaagatttgaaactcgtgccgatgatttcttctctaattatgtctattctttccctgaatctctaactcgtgattttgtccaaattcattattcgccaagtaccgaggaacttgataatatctccccattatttaaaaaaatgacggaagcaaatactggaaatgagtattttgttgatggaatttatacaagaaaatgaataaaaaatttcattccggcctttgatatttcccaggcctatgcccaaaatttaatttcccggtttagcaatttcttccttacaagttttgtaataacaagaaacaacgagaatcttgaaaaattatatcaaaatttactaaaagcatttaaaaatgcccaaagtaaaaatttatatcaaaaattcaatgacttatccagtcagcaagaagctgaaattaagaaaattattggatctcaagaaattccgtctaaattcattgataaagttctccaagaaattgaaaacgtagacaaaatcaatgagatctccagtaaaatcaataggcaaaaagccgatcttttcagcgaactaacaattgaagttaaccgaattatgcaagattatcaaggcgaacttggaaattataaaaattatcataatcttaatattcagccagttgtcggaaataaaacctgaataaacggctatattaataaaaatgtcttaacaaataacgggtttttcaaagatcgtttccaaagaaaagtacttaattgagaattatatgatgataatttagagtcggtaaaagatccaaatattcgaattaaaaatctaaatggagaaaaagtcgataatcgtgccgaggcattttggtattattctcttaaaactcaaggtgtaggccaaagatcagtttcgggaatctggcgggattcaaaacatgataaggttgctttttggggattctttaaatctcaagatgcaaataaggcccattttctaacattagaagatgaatctactggtcaaaaattctacattcaactagctacaaaagggacaaacaatattttttatctaaaaaaacaagcagatcttagctctaaatgaacgcttgaaaatgaaggttataaatcctgagtttcagcttggtcaattattggggagtttaaaaatgcccttttaagacccggtgtttctggaattaaaagatttagaatttatttctctgatcaaaaaagacaagaaattaaaggattatttactttaggtaatacaaaattcatcgccgaaaatggaaaaaactatcaaacagcaccaacttatattgaaaaaaccgcaaaaggtaactatttggtaataaggccacaatttaaataaagggaaaatcatgaaaaaaataaaaaaacttttaattttaaacactttttttccaatttcgctgctttcattagtttcttgtaaaagcgcccttgaaaaaaatcggcaagattttgactttggtgttgcaactccgacagttaatacactaaattatataaagaataattcagctcatgatattttaaattcacttgttgaatcatttgtaaaacctgggccttcggcttctaaatcttatggagcaaaactaaatctgcccggaatttcttttgaattatataaaacaagtcttccttcttcaagtggaaatgaaattatggaaaatcctgctttgatctcaacagctgcatcttcttatcaaattagtgattttggaatgactgcgggggtagtttctccttcaaatggcggaggtaaatcctttattggaattcagaatgagagtcaatcaattgtttcaacaacaatttttttaaatcaaggggcctcaaaatgatcaaataaacaacctgtggttgcccaaaattttattgattatattctttatgtgctaaatattaatgttgcctccccaaatttagttaaaactttatcgctaaatatcaaaaatgcccaacaaattaactcgcttcaacaagattatgtctcaaaatttggaagtccttatcgtaatccttttggtcaaaaaagttataaaaaagatgcaaaaactgggaaagtcagtcttgattttgaccaaaaagttttccagtcacaaaataaaggtgatcaagattttgtcgatcaatttcagaaacttgcaagtggctttggaatgtatacaggtcaaatttttgagcagatgacaaataaagaagtagtcgaacttgttcaggcaaacttatcactaaatccagattttaactataaatccaaagaaatttatgtaattgaaaatggtaaaaaaactacgataaaacttacaagaaatccatttttagatccaagccaagtttttgatggcccaaatttagtcccaagatatgattttttacctggtgatgaatatggacttcgaatccaatttgaagactcaggtgccaaaaaatttattaatttattccagcaaattatcagacctgaatccctaagaccgattaatcgtgaatttgttgagattaatgccgggggaattgataattttggaactgatctttcaaaatttatgacaaatggcccctttgatatcaccgagatcaactggggttcccaaggttcaatgattcttgaaaaaaatcaaagttattattcggctgataaaacaattccaagtaaaattaaaatattttttgccgaacagcccgaacttctttcttcactttttttagatgggtatatcgccaaaacaaaaattccaactacttttcaatcaaaattttgatctgaaaacaaaacaagacagtatatgcaaaaattaaccggttatgggacgattggaattcaactaaaccttgataatgttaaaaaaggacagtcctgattacaagatccagatcttagaagagcaattttatatgggattaatagggttgatcttttgaatttatacggccttgatcattcttttgcccaaactacttggtcaaattttgacgggattctaaccgctcggggttatccacttgagactttcttaggagatcgaaaatataaatctgagtttaaaggaaaagatggtaaagagcttgaatttcctgttttagcccagaattataaaaaacatttagcaaaaagtgtatgatttgaggctgttccaagaaaagatgaaatttataatcctcaagttgcaaagtttttccttgatcggtttaggaaaaaatacccaaaagttgctaaggttagtctaaattttatttataaagatgataatgaagaaaaagttgccactggtcttcaagatattctttcgccaaatacaaataattttatccagattgaaccagtaagacttcctgatgggatttatcaacaacggattgctaaaggtgaatttgattttacaatgaaaaattttgactttttcaacatcggaagtgcccaaccccattcttatattaaagctttttttaattctgatgagatttctccccgcgataataagttttccggacttgagtcaaatccagccgcttcacttacttattggaaaatgtggaactcacttacaaaagaggagaaaaatgctttagtaaaaaggcttgaaatttctcctatttatcttgcaaaatttgaggagttaattacaagaaaaattaagctagataatcaaaaaaatccgatttttaaagaggtttttctaaataaagaactaaaagacaaagcactagatattaatcaaaagccaattttaataccggaatatgaagaaagtcttgatcaatataatgctcggattgatgctttttttaatggtctttttagtgaacaagagaaaaaagagggttggacccaaaataaggtttttgattttatagttatttttgaaaaaattatccgcgaatttgttccaattatcccaattatggaggttgatacttactgaattattaaccgaattcgtgcaggcgatagtaactctttccaatttgcatttgatgttgaaaacatcaaagttaattatctaagtcctgaagatggtaaagaatagaagctaattttagtctctgaatttaaaaaagtactataaatttatagtacttttttatttttgaggttaaaaatttagcatataaaagatttaaatttcaggtttgggaaaaaatatagccatagattttctaaaataattataaaccgaattagtagaatttctcataagttggtaagaaatcttgtataaaaagtttcttgtaaaaataactaccactaacgtaaaacaaaaatatggtataaaaagaagaaataagccaagacctttaagggaatttttatcagattttgttgccatagcaaatctagtaaaccatcctttttcgattatattcggaatagtttcaataagaattgttaataagacaaaaaaagtaaataagataaaaaaagaacaaattcgagaataaaaaattcgtaaatgaactttatataggaattgttttttgtcgttttcgaattgaatttcgtccggatttaattcaatttcacgaataatcatattaaatcgattaagaaatagaggggaaaacggaggtttgataacaaaattatagtattttgtatcaaattcattatttgatagaattaatgcttcacgtttgtattttctaataaatcatcaacctttaaataaaagataagataaaggaaaaataattaaaaaatatacaacaagtcggaaccatataatagttttatctataggaattttggaactaataaaaataagagcgagtaatgagcctaatcccacaataaaaataaagctaaatattttaaaggttgtatttaggaataaacaataaaaaaataaactaactgatttcataaaacaaattagtaacttaatacttcatccattgctctttggattctatttattcaatcctggatagtgagaggttgatattcagtaaatgaacttcttttttacgtgatttttgttttttttatttttgattttgctcaaaaaattatcttcaattatggcaaataaattttttaatttattttttagattttcctcataaggttgagcaacaacaacattacccaagctcaaaaggttatttaattctaaatttttcattttaataattcctaaattcacgatataattacattttgccataaataacaagaaattgaaatatttttttagatagtttagcaaattattcaatgttttactataaaaatttcagaataataaatattttatccaattaatttttttctattaaacctaatgttttaaataaaaaacattatttctggaatttttttattatttaataggaaaagtgaaaagatttatgaatatttaaaaaatttaaaattatgtatttttcgaataaaaaaatgaaaattagtttaccaaatattaaattaattcaaaataataatgaaaatttaataaacgttatccagggaagttttgcgctaaatttttatggcttaattaatagaataccaaaagatttgagtttattaattttttttaataatttttaaatcatcaataagaaaaatataatttttaaatcaaaaatttcagcatcttgaaatttggaaataattgaaataaataaatatttcacctttttgaaaattttaagaattttagatttaaaatataaaataaatcaacaactaaatgataaagaaattttaatttattcgaatgaaaacaaggaatttatctttagtactttatataaattagttgtacttttaacctttatttagtaaaaaatactttaaatttaagtattttttaatttgttttaaatctggcaagattgacaagtttcataattttctgaatcctcaaggacatcttgacgaattcttacatagtaaattgacttacaattttttttaaaagcataaatataagctcgatttaagtctcgagtagtcgccttgtcggtcataaataaggtcatcgagattgcttgatcaacatgtttttgtgcttctgagacaatgtttataatcggaattggacctaattcataagctccgttttgataaaatttgtatgttttaggacttaatttatatgaaggaacataaattctccctaattttccttcttttcttatctcaactggggcaacaacgggctgaagcgaaggcgtgcaggaactaagataggaaattgagcctgtaggagcaatcgccattagatgtgagttggcaattcctgtttttttaattttttcaacaagatgaattcaatctttttgagtcggaatttcaacttgatattttgcaaaaagttctttaattttatgtgtttttggtacaaaagtattcggggaaacttttgtatatttatcaaaatattctcctgatgcaaatttggttttttcaaatccagaaaaaggaccatatttttttgcaagtttttcagaggctttaaaagctgaaaaagctaaagtatagaaaaaaatgttagtaaaatcaagcgcttcctctgagtcataaaaaatttcatttttagccaaaaacccgtgtaaattcatcgccccaaggccaattgcatgatttaaattatttcctttttggattgaaggcgctactgagagatcagaatttcgcgagacaacatcaagagctaacactgaataataaaccatttcttcaaaatcagggcctgattccatcgccttatcaatatttagcgatcctaaattacaacaaatatccttgcctatttctttaaaacttagatcgggtaaaaatgtgcttggagttgaaggctgtgtgatttcgctacataaatttgacatcacaacgcgatcaggatgagcattttctttattgacaatatcttcaaataaaatataaggataaccactttcaaaatgtagctcggcaataattttaaataactttcttgccgaaataaatgtttttttaatttctggatttgctagcatttgataatatttttcactaatagaaatatcactaaaagctttttgatatactttttcaacatcatagacagaaaaaagcgccattttttcattattttttgctaattcaaaagtaatattcggaattattatcccaagagaaagcgattttatcctgattttttcatcagcattttcccttttggtatctaaaaaagccagaatatccggatggtggacatttaaataaacagccccagcaccttgacgttgtcctaactggtttgcataagaaaatgaatcttcaagaattttcattaccggaattacaccagttgcttgattttcaatgtttttaatcggggcaccttgttcgcgcaaatttgaaagtaaaacactaacaccaccgccacgttttgaaagttggagtgaggtagtaattgccctggaaattgattccatattatcttcaactcggattaaataacaagagacaaattcacctctgtttaattttccggcatttaaaaatgtcggggttgccggttgaaatcgacctaacataatttgttcaagaattttttcagctttttgaaaatctccttttcctaaaaataaactatttagtaaaactcgatcgggaaaatgttcaaaatatactaaattatcattagattttagtccataagttgaataaaatttaaaagcccccataaaagaagaaaaaaaatgattataacttcaagcttttgtatttaatttctcaagttcttggaatgaatattgtcctaaaactttcggatcataataattattttgaactaaaaattcaattctttccttaaaagaattgaaaaatttaaattttggattaatttcttcattaatatatttctctgctgctaataaatcaaatttatgtgaatcaggatgatttgcaaaaattttgctatttgcatttaagctaagataacttttttcctgatttttatcaaaattcagatccaaacccacttttttcatttattttctcccaatttagttagcgaactaactattatattcattattttttagcttattttcctcaaaaatcttctaaaatttgccgaaccttttttacatcatcatttgttcctaataattcaaaactatataaaaaaggaacttttaatttttgggaaataattgtgcctgcaagcgcaaaagtatcgccaaaattagtgtttccagaagcgattacagctttacaaaatcgacgattttgttcattgtttaaaaattttattacctgttttgggacagccccacttcttagaccttttccgccactataagttggacaaaaaagtacataatctttatcaactactaattcttggtcaatctcaacaggaattcttgctttttcaaagtttaatttttcgacaaaccgatgggtattattcgaaattgaggaaaaataaacaacaaaaatttctcctcttaatttagatttgtttattatatcatatttttcatcatttgtcattttaaaactcccaatcttcatcttcggtttcttcagcaagcgccattacataagaagagccatttcctgaaaaaaagtcatgattttcatcagctcgagccgataattgactaaaaatttcaggttcaatttcggtttcctcttttgaaaaaggtgaatcatatcctagattttgcaagaatttcccggcattataaatgctaaattttattgctgattcagcaagtccaacttcagaatataaatcatagagataatctttttctaattcaattagtttatataatagatcaaaggtaaattttttaatttcgtcttgtttttccgggcttaatttttccacttttttttgaaatttataacctgaataataattatgaatcactttatcgcgtaaaatcagtcgaataatatcggatgtatttggcagttttgaacgcgctgaaagataaaaaggaagataaaaaccaccatataagagaaaaccaggcattaaagcagcagcaacttttgattttaaaggatcttcacctacataaaaaggtataagaattctggcccttttttgcaatttttcgttattgattacccagttatgcgcctcttctatttcttcacttgagcaaagggtagaaaaaattgaaccataagaacgagcatgaaccccaaccataaaagcgaaatttgtataaattacctgttcatgatcagttaaagagtgtttaatttgggctacatcaccgattgttgcctgaattgtatcaagtaaagtaagtccggtaaaagtgcgagtaactactttttttcaggtaggtgataaagttcttcaggattcaagatcatttgaaagcggaattttttctggaattcagaaattttgcactattcgggttcaaacttcaagatcttttggatcatttatgatatttcagttgattgatcgcatttttcctgaaaaattattaagcgcatattcgagtggcgaaactgattgatggtagtagtcgttttttatttttaatttattattattactattactatttaattttgaattaatcatatttagctctttttagtgtcttgggccttaattttaccaaaaaatcaaaaatatttttttgtattttttggtaaacggtaaattaaaaaattgattttttacctaaaaatcctatgaatttatagacttttttaggtttaaaataataaaataaaggataaataaaaaggttaaaaaaataattaataatattttttatacattttaaacgattttttgaaaaaaaatttaatttattcatatattttgaaaaagttaaaatatatgaataaaaataagtaaaattccttatttttttggaaattttattaatattttattgctttatgttataatgaaatcagatttaattaggccggaggtttgaaaatgcatagaacaagaacgaggaacatcttaaattgaattaaagtaaaaataatcaattgatgatgaacttctgttataaaaattgatgagtcagtagttctaattttaaaagttttacagcttttcattcttgaatttagtcattaaagttagaaattttattcattttatataaaggttaattttattaacctttttttgttttttcagaataagaaataaaaataattttatatttataaaccataagttaaaaaaataacataatttatagacttttttaacgtttaaggtcagtaactttttttaatcgggaaatttttagttaaaattttaacttttttcttaatttctttaatttcaagcgcatttagctctttttttctcagaacaaaatcaattatttctgccatttgactaaattcctgttccttaaagccccgcgaagtcatcgccggggttcccaaacgtaatcccgaagttacaaatggacttaaagtatcatttggaattgtgtttttattggtgataatattaacagattcaagtaaaatttgcgcctgtttgccatttagattataagaactaagaacgtcgatggtaaaaaggtgattttcggtaccctgagatacaattcttattcctttttttataaattcactagcaaaatgcgatgcatttttaacaatttgggcacaatattctttaaatcaaggttctaaagcttctttaaaagcaacagctttcgccgcaattgtatgaaaaaaaggcccgccttgaattcccggaaagacaactttatcaatttttgcagcaatttctttactgttagttaaaatcaggccgcctcttggtcctctcaaagttttctgggttgttgaggttattatatgggcatatccaaccggcgaaggatgttggcctgcagcaataagcccggcaatatgagcaatatcagcaagtaaaaacgcatttactttatcagcgatttgtcgaaagcgagcaaaatcaatttttcttgaatatgctgaataaccacaaataattaaattcggctttgtttttaaggctattttttcgattgcgtcataatcaagaagttcattttcatctaaaaaataactaattcctgaataaaacattcctgaaaaattgattttatatccatgacttaaatgcccaccagcatttaagtcaagtccaagaattttatccccgggctttaaaagtgctgcaaaaacagcggcgtttgcacttgatccagaataaggttgaacatttgcatactcaatcttaaaaagtttttttactctttcaattgcgattttttcaatttgatcgataaaagtacagccaccataataccttttccccggataaccttcaccatatttgttactaggacttgttccatttgccaaaattacgtcttctgaggcataattttcacttgcaattaactcgatttggctattctgtcttttagattctaaattaatcagctcagaaatttgttggtctctaagtttgattttcttatacattggaattttatacattatacactaaaaaaccaaaaaaaaataatttttttaatttttttataaaaagcctttaaaacacgttacttttttgtttgaaaacaaaaaagctaacaacggtatcggtgtattgaaaaaattcttttttaggttttttagttcaagttttaagaattattaaaaaattgatttaaaaagaaaaaaaacaaaaattgttgaataaaaaccaaaatttttgaaattttgccgaaaatcaggttagtaaatttttggtttaaaaatttttgaaagcaaatttgagaaaaaaacaagaaaaacaagaaaaccaagaaaaatcaaaaaaagaagaaaaaaaactagataatacaaaaaaattaataaaaaataaaaaaaattattttttatgttaaaattataatcgtagggttaaaaattgataatttttaataacccacacaataaaacttaaaaaaaacatatcatatttatatttttgtaaaggagataaatgaattttaaaagaaattacattcaatctttttatgccaatgaatttcattcagaagaaaatccaaaaactttggatatattttccccacatgatggttctgtactggctaaattagagatcacttcaacttcaactttagacaaaattgtagctcaggcaaaaacagcccaagaaaaatgggcatctttaacttttaagaaaagatcagaagttatttataaatatcgcgaattagtaattcgctataagcaggaattagcccatttaattcatattgataatggaaaaactttaaaagaagcagttgcagaggttgaaaaagtagttgaactaaccgaatttgcctgctcaattcctcaattagtcagcggtgaaacccaaatggttagccggggaattattgcccgcgaagaaagacgtcctgtgggagtttttggaattattgctccatttaactttccattaatggtgccaaattgatcaattccaaatgcaattgctttgggaaatgctgtgattttaaaaggctctgaactttgtgggctatcagcaagttttatggctgatctttgaaaacaagccggcctaccaagtggaatttttaatttagtaaatggccaatctgaaattgccaatgcaatgatcaatcatcctgaaattgatggaattacttttgtaggatcaacagagatcgcaaaattagttcataaaaatgcatctaatttaaacaaaagagtacttgctcttggaggagctaaaaatcatatttttgtacttaaagatgccccaattgaaactgcatcttcagaagttttagccgctgctcttggaatggctggccaaagatgtatggcagcatcggttgctttagtagttggtcaaaatgaagaatttattcaagccctaattgaaaaagcacgtaaatttaagttagattttgatcttccccctcttgtttctaaggcttctgttgataaattagttacttatctaaactgggcaaaagaacaaggagcaaaaattttagtaaatggaataacagattttctaatccctgaaaacaaaaaagaaggattctggtttggcccaacaattattgactgatcagagattcctgaaaaaatgggttctcaagaagtttttggtccgatcttagaaataattagaacaaaaaatctttctgaggcaattaaaattcaacaaaaatcaccttatggaaatgccgcttcggtctatacccagtcaggtcgagccgctgaagaaattattgctaaagttaagccgggaatgttaggtgtaaatattggtgttccagtaccccgtgagccatttagttttggtgggacaagatcttcaaaatttggttatggtgatattactggcaaatccagtattaatttctgaactaatttgattaaagttactacaaaatgaaacccggaagacaaacaggattgaatgtcataatgaaaaaagaatttgactttattctaatagggagaattactatcgattttaacccaacagactattataataatcttgaaaattcaagtttatttaaaaaatacatcggtggatcggcagctaatattgcaattgggcttagtcgtctaaaaaataaagttggtttttttggatcagttagtgatgatcaatttggaaattttgttcttaatgtttttgaaaacgaaaaaattgatatatctcgaattaaaaaaacaaaagatcataaattaggtctaacttttaccgagatgctctcagaagaaaaaagcacaattttgatgtatagggataatgttgctgatctccaaattgatgtatcagatattgatcttgactatattttaaggacaaaaattttagtaatttctgggacttcgcttgcaaaatcaccttcgcgagaagcagtactaaaagcactatttttagcaaaaaacaacggtattaaagtggtttttgatattgactaccgtccttattcctgaaaaaatttagatgaagttagtctttattatcaaatagttgcccaaaattctgatttaattattggttcttatgaggaaattcaattaacatcaagattttgccttgaaaatccggaaaatttaattgatgatgactatgcaaaatattgactaaaatttgttgatcttattattatcaaaaacgggaaaaaaggttcaaaactttatcaaaaagataaaaaacttgttgctaaaatcgttccggttaaaatgttaaaaggttatggcggcggcgatgcttatgcttctttattccttgatcattatctaaaaaatgaatctgatcttgaaaatgggcttgcacttgcaacttcagcagcttcaattatggtgcagtcacattcatcctttgatctcccagattatcaaaaaatacttgaatttaaagacaatgcgctaaaatccgatccggatttggttcaaaaaaaggagtgaaatgcatttaaaaaatagaaatttaggtccgggttttcaccgcttagttgatcggaaaaaacaagaaaaagctagttttatgaacatcgaccttgatctttgaaatgcattaataaatgaagaattagactatcaagttgggccacaagatgaatgtgcgattttattaatcaatggagaagccgatttttatctagattcagaaaaaattagtatggcaagaagtaatatttttgaacaaagaggtaaacttttactattaaaagcaggccaaaaaattcaaatttttactaaaaaaccaagtaaattcctttttattataacagaaaattctaaattagatcaaaattatttctatgatgaatcaaattcaagggaagaattttttggttctaatcaatgagagcaagttgctagaagaaaagtaagaactttttttgactattattcaaatccaaaatcgaatttagtagtaggcgaggtggttacttatcaaggaaaatggtcatcttatttgccacattatcatccacagccagaaatgtattttttccagtttgaaagagattcagcttttggcctttcagttaatggtgatcaagcctatattgtcaaaaatgatgatgtaaacgctatccaagctggcctagttcatccagtttcggccgctcctggttatccactttattattgttgaattattcgccatttagaaaataatccttgaactgatcggatcgaagctcaagaacatctctgactaaatcaagaaaatccaaattattgaaaggaaaaagatgaaatttaaagtcggaatcatcggcggaggaagaattggctatgtccatactcacgcaattaataaatttgttgatcaggctaaagtaattgcaatcgctgatgcttatttagacagccaaaatcaggaaaaatttaggaaattaggagtaaaaagtttttatagtgactataatcaattacttttagatccagaaattgatattatttatatttgtagtccaactgatacgcactatctttattcaattcaagcactcaaagctaataaacacgttttttgtgaaaaaccagtggcttttgatcttgaaaaaattcttgaagttaaaaaagttgtaaaagaaacgaaaaaatatttcaccgttggacataatcgaagatttgatcataattttttagcactaaaagatcaaattgaaaaaaatacaatcggtgaaattatccagttaagaattacttcccgcgatccaggacttcctccatatgaatatatcaaaaaatccggtggaatttttcttgatatgatgattcatgactttgacatggcactttttctaactaataataaggtagttgaatctgtctatgcaacaggttcagctttaattgataaaaaaattagcgaattagatgatattgataccgccgttgttgttctaaatttcaaagacggttcaatggcaacaatcgaaaactgtcgtcagacaagttatggatatgaccaaagagttgaaatccacggaacaaaagcgagtatcaaaattgaaaatgatacaaattcaaccttgagaatttcttcagatcagggaataattaaggaaaaaccgctttattttttccttgaaagatatcagaatgcctacattcaagaaaataaagacttttttgaggcaatttcttctaataaggagccaaaagtaacaattgatgatggttataaagcggttttacttgcaaaagctgcaaaaatatctctaaaagaaaaacgattagtgaaaataagtgagttagaggaataatggcaaagacaattcgactaacaaccgcacaggcaattattaaatttattgataatgtttatctaaaaattgatgcaaaaacaaccaaatttgtctatggaatagctactattttcggtcatggaaacgttttaggattaggcgaagcgcttgcaaatattgaccatagtctaaaattaattcagggcaaaaatgaacaaggaatggctcatcttgcccttggttttacaaagcaaaaacatcgcagacaaattattgcttgtacctcctcagttggtccaggcgctgcaaatatgttaacagcagccggaactgcaactgctaataatcttccattattactttttccaggcgatacttttgcctcaagaagacccgatcctgtgcttcaacagatcgaacaaatccatgatttaaatatcactacaaatgatgcttttaaacctttttcgaaattctgagatcgaattaatcgtcctgaacaaattattaattcgctaattcatgcttttgatattctcactgatcctgcaaataccggaacagtaacaatttgccttccacaagatgttcaagccgaagtctatgatttccctgaatgattttttgagaaaagagtctatgaaatcaaaaggataaaagctgatcgcaaagatatagaaaaattagttgatctaatcaaaaatgcccagcaacctttggtgatcatcggtggcggtattcgttattcccaggcaagtagtcaacttcttgaatttctaagaaaaacaaaaattccttttagtttgacccaggccggaaaaagttcaattccttcatctttaaagcaaaatttaggcggaattggtgtaacaggaactcttattgctaatttatatgctaaaaaagccgatttaatcattggtctaggaacaaaatattctgattttactaccggctcaaaaacccaatttgctaaagaagccaaatttgttaatattaatattaaatcttttgatgcccggaaaatgaatggactagcaattattgccgaccttaaagttgcccttgaaagtctaaattacttacttagaaatacacaagaatttggatatattaaaaagatcaaagaaaataaagaacttttaaaggcaaaaacccaatgagaagactatcttaaaaagatctatgaacttgaaaaaccacttgaaaacaaagcgcttgtccttgataaaaatcaaaactcacctgaaaaattcgccttagcaattaaggagcattaccaaaaagatattcatatttttagccaaagtcgcgctttgtatctaatcaggaaatatattgatcctaaagcttcaattaccgctgcagcgggttcacttcctggggatctccaaagactttgagagacagatgaatttggatcttataatgttgaatatggctattcttgcatgggacacgagattcaagcagcaattggttcatcaattgcccttggttttaaaccaacttatgcccttgttggcgatggatcttttctgatgcttcatagcgaaatgcttacggcaattcaggagcaaattccagttgtgattatcctctttgataattccggttttggatgtattaataatttgcaagttggatcaaatattagatcttttgagactgaattttatacaagatcacagaaaaatctaaatgaatatggttctctagtgattaccgaatttgccacaattgcaaaaggttatggatttagatctgtttttgccaggtcagaacaggaatttattatggccctaaaacagtcaaaaagaacgaaaaaaccaatgttaattgagatcaaagtttatcctaaatcaatgactcctggctttgaatctttctgacaaaccggcctttcacttgtatctaaaaataaagaaattgaagaacttgccaaagaaaatgaaaaaatccttaaggagaataacaattttaactaatgaataaaatctgaaaactaaaaaatgttaaagtcggtgtcgctccaattttatgaacaaatgatgatatgcctgaattaggaggtgatatttcttttgatcaggcaatttcagagatggcagaagccggttatcagggcaccgaaattggcaataaattcccaaaagatgaaaaaattttactcagggaactaaaaaaatataatcttgaaatcgcttctgcttgatttagtggatatattatatcagattttgagaaaaattttcaagattttcaaaaacattgcttatttttaaaggccttaggagcgaaagttgttgtttttagcgagcaaacttattcaattcaaggtcaaaataaaccactttttaaagataaaccttattttacaaatcaagaatttgaaaatcttgcccagggtcttaataaatttggtaaatgatcaaaacagcacggaattgagctagtttatcaccatcatatgggaacaggaattcagtctcttaaagaaacagaaaaaattcttgaactaactgaccctgaatttgtcagtctgatttttgatactggtcattttgctcatgctggcgaagatattgttttttgtcttaaaagattaatctcccgaataagacatattcatctaaaagatataagaaaagaaaaaattaatgaactaaaaacgaaaaatttaagttttcttgaaggagtaaaacaaggaattttcactgttccaggcgatggtgatattaaaaattatcctttatttttcgagcttttagccaaaaataactatcaaggctggctaattgttgaagccgaacaagacccgcgaaaagcaaatccacttgaatatgccaaaaaagcaatggattatctaagatcactaatttcatgatagggaggtaaatattgaattctatccaaaaacatccattattttttaaacttgagaaaatcaatttaagttttggccctgttaaagttctaaaaaatatgaatttagaactttataaaggcgcagcagtcgccctaattggcgaaaatggggcgggaaaatcaagtctgatgaaagttttaagtggggtttatcaacctgattcagggaaaatgaacttttgtagtgataatatttgcaatcaaaaagttgaattttccggggtaattaattcccaaaaacaaggaattgccattattcaccaagagcaaaatttagttgaaagcctaagtgtttcccagaacattttcctgggacgggaatttcggaattcctttggacttttagattataaaaaacaagatgaagaagcaaaaaaacttttagatactttaggggctgaatttagtccaaaagcacttgtttcttcgctttcgatctcacaaaagcaatttatcgaaatcgccaaagctttatcccaaaaaccggaaattatcatttttgatgaaccgacttcggttctaaccgaaaaagatacccaaaaactttatctgcttgttgaaaaacttaaaaaacaaggaattgcaatcgtctgaattacccatagaatggaagaaattaagaaaacttgtgaatttatcactgtgattcgaaacggaatgtatattgaaagtaagccaataaatgaatttaaaaacgaagatgagattatttctttaatggtcggttttgatatcgagcagcgctatcccgaaaaaacgccggttagaagtaaaaaaccatcgtttttagttagaaatttatcaaatgataaagtttctaatatcagttttgaaatcaaaccaggtgaaattttagttttttatggccttgtaagttcaggtcgaactgaattagctagaactttaattggcgatatgccttatttaaatggtcatattgaactaaatggtcaagaatttcgcccaaaaaatattaaggacagtcttgatcatggaatttattatctttctgaaaataggaaacaaattggtctaaatgttaatttaccaattaattttaatatcacaatttcttctcttggctcaaatcagattttttctttccttccttttgtctcaaaagcaaaaataactaaaactacaaatcattatattaaacaattaaagatcaaaacaacttcacaagatacgccattaacttctttatcaggtggaaatcaacaaaaagtttcacttgcaaaagggcttgcaacccaaccgcaagttttcatcctcgatgaaccaactcgcggagtcgatgttggcgcaagaaaggaaatttataatttaattcaccaattaaaacaagaaaataaaacaattatgataatttcttcggatatgcaagaggttatcggaatcgctgatcgggtaattacaatgtatgaaggcagaattacaagtgaattagttggcccgcaaattaccgatcaaaatataatgaaatattcacttaatttatagaaaggaaattagatggtaaaagtctgtagcaaattgaaaaaagaacatcattttgagtttgtcgattcacttgattttttctcccgggaagcaaaaattgccgagataagaagctattataaaaaaagaatcgaatttaaccaagaaaaattagatacagcaatttatgcttgacatgatgatttttttaaccttaaagtctcaactgatgatcgaaaggattttattgaaaaaaaagcccaaaaacaaattagacttgctcaaaaagccttagaaaatcttgagaatcaatatctaaatttagctctcgatcaagcaagttttgaatcccaaaaaattcatctacaaaagcagattgatcaacaaattaaagaaattaaaactaaggccgaagctaaaaaacgtaaagcggatgaatttttagaaaaacagcgagttaaatacgaaaaagagatcgctaaaaaagaagctctccataaaaattttatggattatattcatcaagattccaagaatcaaatcaataaaataagcaaacaatttcagcaaattggtgaaaccgatccaagtttttttagctcaagacaagaaaaacttgcccaagatctaagagttcttaatcgtcatacaaaagcaaaattagaaactttagaaactgatttttctctacgaaaaattggaaaaaatacttttttagatcagaagaaaaatattgaattatcctatctaaaagaagtaaaaatgctgcaaaaacaagcacaaatggttcatccaaaaatgagaatggctacaaaaatctgaaactttttaaaattcagagaacaagatcggttcattaacaatgttgaaagagccaaaaaatccttaaataatacaaaattattaattttgtttttaattatcgcctttattaccggagctttaaatgttaatttttttagttcttataactgatttgttgcgattttaaaaaataatatttttattggatttatcgccttaggtcaaactttagtgattctaactggtggaattgatctttcagttgggtctctaattggttttggcgccacgatttacctgcttttaacagttaaattaggacttcattttgttgctgtcttatttattttgatcattattttagctgcaataggaattttaaatggaattttgatctcaaaatttaaaattccaccttttattgtcactcttgccggacttttatcacttcgaggggcaattgcgattttattaaaagggacaccgatcactaatgctcaagatccaatttttaacttttttaactataatttaggctctaatttctcggttttggttcttgtatttattatcaccgttgcagttttaatcttttttattaagttttcaaaatttggaagatatgtctatgctgttggtgataatccagttgcagctacattttcagggattaaaaataataaaattttaattttagtttatatgttttccggaatctttgcgattttaggtgccctttcaatctcatctgggacaacttcggtatctcctaataccggttatggttttgaacttgatactgtaaccgccgttgttttagggggaacagctcttactggtggaaaaggaggggttggaaaaacgattattggatggtttgcaatggctttattattaaataccttctcatttttccaattagactctaacttccagttagtcgcaaaaggaattattattgtccttgcaattctttttgatcaaaaatatcatatcaatgaaagattatccaaactttattacaaagttttagtaaaaatttagaaaggaaaaatttaaaacttttatgtccaaattatttattagaacattatattgagtacttgggcttatcgctgcgattgcaatttattttggaaccgcttttgggatagcttcaaggtcgaatacaactgccaaagttgccccagttgctgttgttttttcaacaagaaataatccttttttccaaaatgttgaaaaagggattgaaacagcagcaaaagaattaggagttgactatgaagtctatgactctgaaaatgactcggataaagaagcaagaaatatttcaaatattattgcaaaacaacaaaaagttgtaatttttaacgatgttaatgaagattcaggaatctcagctgttaaaaaattaaatcaagctggaattccggtaattgccactgatcatttactaaattcgccaaaagccttagaagcaaaaattaaagttgaagccaatattgcttctgataataaacaagcaggagtaattcttgcccagtttatggcccaaaaaattggacttcctcaagattcacttacttattcagtctatggaattcccggaactgaatcaggtgaatcccgggcacaagggtttattgaaacagttaaaaatctaaataatcaagcaataaaatacaaccttttttcctatggaaaatatggaaaagaaaatgcaaatggaaaaacttacatcggaagacaagctgatgataatcgcgatctagcaaatcaaagagttgcaaatgatgcaacgcaagtattccaagatgctcaaaaaaggccacttttggtttttgggactaatgatgaagctgccttaggttcaatttctgcccttgaaagtgcccagattccattaggaggtggagataaattccttccaggttcaggaaaagtttatattaccggagttgattatacaaatgatgctcaaaaagcggtattaaataataaattatcagcaactgttgaacaagatactgatcttttaggaagactttctttaataattgcagaaaaaattcttaaagatcaatgaaaaacaagtaaatattctgatttttattcacaatttcctcagcttgataaagataaaaatcctgatgatcaagttgagcaaggatattattttaaagtaggaacaaaacttttctggaaaggaccagatggaaaaggcgaaaaacttcaagccgatgaaaatgggatactccaaaaggtaaattaatctataaaaacaaggataatttatgaaaaaagcaaaaattaaagtcggtgttttaggactaggacgaatgggtctaagccatgctgaaaaccttttagataaaatccaaaatgctgaattaatcgcactttgttcccttgatgagacagcaaaaaattatgctaaattatgaaatattcctttttggtataattcttatgaaaaaatgcttgaaaatcaagaaattgatgctgttattattgtaagtcctaccccttatcatccccagaatattcttgatgcccttagagcaaaaaaacatgttttttgcgaaaaaccattaggaacaaatcttgaagaaatttataatttagtaaaattagcaaaaaactatcaaaatcaagtaattcaaatcggctttatgcgtcgttatgataaagattttcactatgcaaaacaattagtagaccaaaatcagatcggtaaagttttttatgtaagaactctttcccaagatccagaaaaagatattaaaaatatgttttattttggaccaacctctggtggtcaatttattgatgtaggcgctcatgatcttgatttgatgatttggtatttaaattcttatccaaaacgagtttgatcacttggtgatgcttataaatatcaagaatttcgcacttgaaatgatggcgatgtggttgcggccatgtttgaatttcataatggatcaattggaataatgacagcaagccggattggccctcaaggttatcaagcccaagcggaactaattggaacaactggccatctaaatattggcctaattgatgcaaaaaataacgtaattagtctaaattctgctggcgcagttcataattaccaccggaattttaactcccgttttaaggatgcttatattgctgaactaaatgattttgtcaataaaatcattgaaaaaaattatgataaaacgcaactagatgaggcattagtaaatataattgcacttaaaaaagcacaagaatcatttcaagataagcaaattaaggaaataaattatccagactggcttgaaattaaataattaaaaaaataaaaataacaaaaaattagaagttaaatacttctaattttttttatattttatccaaattttttctttaattttaattaaaatttaagaaaaaatttgatttatttccaaaatcagaattttgccatcgatcttgaaaatattcctcagcccgttgatcaattactaatatccctgtcaagatcaaatggtcttataattccttctccttttttgattgcaagatataaactatttttaaattcttcattttcttcaaaattatcaactttctcaaattcagcaaaaccgatagcaaaaaccttataaaaaataataaaatattcccttaggtaattaaaacgaagaaatcagaagggaactgcggcaaaagaaagtagtgttcaagtgataattaaagtgccaattccggcatattcaatcaatatatcataatcatttctgatatttttgaaaaatgaaaattgaaaacccattttaaaaatagtaacagtagccgctgatcaaaaaagtgttaaaaaaatataagataaagtagataaaacaaataaattattatggattttttttacttcctcaaaataatttaacttgtaatcccgtaatttaaaatcattggcaaaaatatcaatttctaataaattgtatttgtatttagaaataaaatttgacattttatttaaaaaaaatttactgaatataatcgtgttattataaaattggtcaaattttgagattttttccccgttttcttccttaaaatctcgaaattcaattcagaatttattttcaattagaaaattagttttaataaattcggtttcaaaatggagagataagccttttaaaaaaagatgattttgtcgatacttttttttgctttccaatccaaatcagataagtaaaactagtaaaattatacaaaaaacaagcaaaaatatcaaaaatgtattaattaccaataatctatcattaacatttttgataaattttgaattttttttaataaaaggttttatatcaaattctaataataaaattgaggttagcaagataaaaaatacaagaaaaaacagcgaaaaaatcaaaaaaattgacttatttttcctgatttttcaattaaaaaaaagaactcatttctcaatttcttttttttgcattttttatttgctttcttgaagttctgctgaaattaccattgtagttacaaccgagacaattgagtttaaagtatcgagaatatttagcgctgcacttatcggatttacataaccaacactcattaaaagtccgcgttttgccgcggttttaattgtaagttgttttattattttataggcattcttaatccattttagaaatatagttttttttattaataatttagcaattgtttcttttgtaatttcatcgcttatttttctgccaataatttttatgattgttttttccattattttttctatttgttgtttgattaatattcgtattggatttgttgctgtagaaagatttgcaatattataataaaaacctaaatccataccacgctctgtaatttcttctcttaattgatccttaaattcataaaatgacattcccgaaaattttatgattctttcatattcagaggagtttttaaattgatttattttttctcaatcttcatccatttctttctggattttaaaagattctcatacaaaatatgtcattattgatgcttgtatcgaagcagctgcggcaagcggagcggttgctccaaaagttcaaaaagccaaacctgtataagttgcaacaagtgctcaagctgtccccgctaaaactgcagatgttatatttagcccttttgttgcattataaaatctttgatatttacctaaaaatttctcaaattgcttctttgattcctttgtttcattttgtaattttaaaaatttttcttcccactctgaatcatttagtattgcatcaattattttttttcttcattttttgttaattttttagcagtattgctcttttcagatagattattagaatttttttggctttttggtttgcttctattcatttcctcttttattaaatcgttttcataattgttttcttgaatttctggtgtttgagtattaacaagtggtaaatttgaatgctgaaaatataaattaagagcatctgttgatgttattctttttgactttatcgcttctaagttctcataaaattcttttttaaatcttattctttgttcaatatcattaaaattatccaggttaaaatttaaatattcttctacttcactaaattttgaaaaatctacatcttctattaattcttgcatttttgtaaaatttttatcaaatctttctaacatagaaatactttcaatgttatcagccaaaattttaataggcggtgtagtatcaattggttttgaaattatcagaggatttctactttgataaatatccatatttctaacttgatagacagggacaaaaatccctggaagttgagataaatcacctaaattaaatagaattttcttcatgaatcacctcattatttataatttttgctaattgatcaagctgataaaatttcttgtcaatttcaagttttaatactttaattatatttgaaaaagtggacttttcaaccaaaactttaaaaatatttaaaggtctattcggatttaaaaaatagaatttttcctgtttttcctttaaaaacttaaattttacttgttctaaaagttttttattttcaccattgataaattttgagtcaataattaaaaaattttcattttcataattttggaaattagtaactattcgcgcgtattttagataaaaaactaaattttttgttgtggttatcttaaaatgtgactcaagagtaactgcatcaaaaataaaatctattttgctttcatctttttcctttaaattctcggctgtttctaaattaggatttaataaaaactcttttattaatttaatatcttcgttagtcggggcaaactcaattttttttatactttcaaattgaaaatccatttcaaaaatcatttttttcattattcacttattaaaatctagaacaaattttttttctggatttaatcggcaaaaaataatactagtaaatccaaaaatgaaaaatgtaataaaacaagcaacaccggtgtataataacggcaaaatatcaggatttattcgttttgtttgtatataagattttagggaacccagcataataatcaaagtaattgttaaaaaaacacaagttaatgagaaaaaaatagtccaaaaaatttttaaaacaaagtatattttatctaatttcttagttaaaaacttttgatcctgtcaccgataccggcttatattcatagaatatttcattaaaatttctttgattattcggctattcttatcttctagcataacatataaaactactttaaaataatattattttatcatattagttaatttttatgaatttttaattttaaaattagcctttaatttatagtgttttttcatttttagtatttctttttaatcaaaaatagtaaaattcatctttagtcacgcttttatggtaattttattatatttaaatatatttttgcacaataatataaaaaacatattaaattattaaatcattaaaaaaatattaaaatatacccaattattttttaaaaacatccaaaaaatggtcaaactttaaagaaatatggaaggaattttttaataagtttttcggatttcataatttttttcactaattaaaattctaactaatttatattaaaaaatttataagaaaagcttgaaaattttgaaaaatttgataatatttttgttaattagctttcttctaaccttttcgtcaaaaaaaccataaaaatacttattcatattattaaaatatgatataattgtaaactcgagaaaggaaaagcatgaaattaggtactttttttgctaagttgttttcgcttaatagttgaaagcgcttttttcttgcttttttgacttttgcgcttcttggaagtgggatttttttggtttcaaatttttatatttctaaaaatattaatcgttcaattgaatatggtggtggggctgaagttttagttcaagttaaaactttagatggaaaaattccatcatctaaagttgtaaaagaagctgatgcagcaatttttcaacgcctaactggaggagctaatcttagtgggacaagcgttttcactgaaggcgaaggtcggattagaatttcccgtaataaaatttctaataatcgtgaattagacacttttattcaagaaattgttaataaaccagttttaaccattactgatgttgatacaaatccacttttttttgaaggaaaatttgataaaaaccttaaattagaccagggaaacgaaacaaattggattgttccttttgctccaggttctgcaatttcacaaccaaatccacaaaatccggcaaataatcaagtattaattgagctaaaagataaaaaagctcaacttgagtgatcaaaagcaacagagtatatttcaaaattaggtcatggtaagaatcgaattttgatttgatcaaatattgttgaattaaaaaagattgcaaaagaaaaattccctgcccaatgagcaaaatccggcgaaaatatttataattttgtccatgttggcgagaaaactacccctgaatttcttcagggcaataaaattttacaaccagaacttaaaaaatatcaatttgatgcgaaaaaatatttgatttccgatgcaaccgtttcccaagcgctaaatggaaaatcctttgtaattactggaagatttacccctcaagaagcaaaacaattggcccttgatataaattatggaacagctgattataaactagattttttatcagcatcttttgttagcaaaacaaaatcagattcagtttttattgcgggttgaattgcaattgggcttgcaattgcaataatttctttatttttgttaataaattacgggcttttaggtgcgcttgcaacaatttcgctttcattatatgtatttctaacattactttttttcacaattgtcagaggtgaatattcgccgattacaatttcagccttagttgtgggaattggaatgaatattgatgcaaatgttattagttttgaggtatttaaatcccgaatttattcaggaaattctgttttaaaagcaaattatcaagctaatcgattgtcttttaatgcaattcttgattcaaatattacaacactaattgcagcacttgttctgttcttttttggtactaaaaatgttaaaagtttctcgattactttgattttttcaattattttcactttaatagtaacaatcggctttacaaaattttttaccagctttattcttaaggcaaactttttccaaaataatgaaaaaaaactttgactattaggtatcaaaaaatattatcttagaaaatatcaacgcggttataattcaatttattcacaaattgattatgaaaaaatttataaatatacgagatgattgccgcttattttgtttttaggttcaataatagtttttgcagtttttgccggaatttatagatcatttggttcaggatttaatttagcaattgattttagtggcggaactaactttttaattgaaagctcaaattcaagttatgatttaattacaaaggaaaaagccgaaaaaataattagttttcttgattcacaaaatataaacaagtcaaattcaacaattttgcttaatccattaaatgaaaatggaaatatttttaatcttgaaattaaaacaaaacttgatctagcaacaaaaattgcctcattaaatacggcaatccagaataatttttctaatattcgaatgacaaattattcaatttcgaatgaagaagctcaaaaattaattttcaatgcaattctttcagttggaatcgcacttatttttgtaactatttttacgctaattaggtttaaatggactttttcgcttgcaataattttctcacttctttttaatgttttaatggttttgctagcaattattattacacggatcgaaatatcgcagaatttagttgttgcaattcttactttaattggttatacagtaaatgatacaatcgtggtttttgatagagtaaaagcaagattttcagaaataaatcatgaaaatgtttataaatttgataaaattaaagaaatttccttacaagcaattagagaaacagcaaaaaggtcggtatatacatccttgacaaccattttaacaattgttgttttaatgattttttatgaatcaattgatattgtctttagcctgacgatgttaattggtgtgataattggaacatattcctccttatttatcgcaacccgcatttggattattcttgaatcataccgtaatcgtaaaaaagagatgagaatcaataaaaaatactgaaatgtccaaaaaatttatgaacaaactttcgcaaatattaatgattatgaaaaataatataaatcaactttttctattgtggggaaaatcaaaaatgttgatttttttctaatattttatttgataacttaaaaaaaggtaaaaagtgaaaaaaaagttaaatttatgcccaaaaggaacctatgatttctttggccaaggtgctaaaattttcattgatgttcgtaaagttttttttaatcaggcaaaaaaatttaatttttcttatattgaaacaccaatttttgaatatgcaaatatttttctaacaacaaatcaaatcgcagatattgtaagtaaagaattatataaattttttgataaatcaggacgtgaattggcactaagacctgaaggtacagccccaattatgcgctcggtagcccagcataaattattccaaacagaaaagaaatttttctattttggcccaatgtttcgctatgaaaaccctcaaaaaggtcgatttcgtcagttttatcaagccggatttgaaattattaattataaaaaagattcactggaattccaaattcttgaaattattcttttaattaaatcgatttttaaagaccttgggataaatgaatatgaacttaaaattaatttcctttcgaatctaacaacaaggaatatttatgaaaaaaatttggcccaatattttgaaaaattcagtgataaacttgagccaatttcaaaaatacggattaagaaaaatccactacggattcttgatgataaaattgaacaggaaaaagaatttgtcaaattagctcctaaaataaatactttttgaacaatggaagataaaaatatttttaatagaataacttcaattctggaagaatttaaaatcagctataaagttgattataatttagtccgtggtcttgattattatgatgattttgtttttgaatttattgatacttcacaaacacttgggacaaaattagcgcttgtaggagggggttgttataataatttgccgacaaaatttgggcttaataattttaaaagtattggaatggcctttggaattgaacgcttaattgagattctaaaatcaaaaaagaacataaaagagcaaaatcttgacttttttttattaagttttaccgataaagaaattttgctaaattttaaattagcaaaaatattacgaaaagaaaattttttagtcgatttaaataaaacaccattttcagtaagtaaaggttttcaattagccaaaaaatctggagctaaatttgtttttttctttgaaaaaaatcaagcaaaaaattatatttctctaaaaaatttgcaaactggaaagaatgaacaaattttatatactgaaattaattttgaatatctaaattcaattatcaaagcgagtgaaaatgcataattcgaaaactttatccaaatctgatctcggaaaaacagttacaattcaaggttgagtacaaaatattaggaaaattaaaggcaaaagtttcgtgataatccgtgattatcaaggaatttttcaagctgttgtaactcaaaattcaaaagttgatcgattcaccaaggaatctgttgtcaaagttcaaggaattcttactcagcggataaatccaaataccaaaattcataacggtgatcttgagattctagttgataatttagagacaatttcattagcggatcagattccttttgaaattagcgatcagctagaagtaagcgaggatttacgacttcaatttcgttatttggatctacgacgccaaataatgaaggaaaatttaacatttcgttataaaattttccattatattcgttgttttttatataaaaacaactttattgaaattgaaactccaattctttctaaatcaacaccagaaggtgctagatcatttttagttccaacacggcaaaaaggcaaatttttcgcacttccgcaatcaccacaaatttataaacagcttttaatggtttctgcttttgaaaaatacttccagtttgctcgtgtttttcgtgatgaagatctcagaaaagatcgtcaatttgaatttttacagcttgatttagaatttggatttcccacttttgaaaaaatttcagaggaaattgaagcactaatacgtgatttatgaacaaaaatttttcccaatttagcaatagatttcccaaaacttacttattttgaagcaattaagaactatggaactgacaaacctgatctccgttttgagactaaattatttgatttagactttcttaatgatatagacttgctttttcaaggaaaagttcgcggacttttccttgaaaaagttttaattacaaaaccagaatatcgaatttttgtcgaaaaaattcaacaaaataatgcaaaaacacttttatacctgcatatttttgagggaaaaattacttatttttcctttaaaactagtgaaaaactcttaataaaaactaaaattgagaactgaattttgcaaaataactaccacactggcacactatttctaattgctgctgattataagattgcttcgcaggcacttggagcacttagaaatttagtcgcaaaaaaatataaactgattaacgaggatcaatttaaatttgcctgaattattaactggccactttttgaattagatataaataacaaacttacctcagctcaccatccttttactgccccaactttagaaagtcaacaatttttgcataaaaatcctttaaaagtccaagctcaggcctatgatcttgttcttaatgggtttgaattaggctcagggtcaattcgaatccacaatgcggaattacaaaagcaagtttttacaattctcgggcttgatcaagaccaaattcatactcaatttggagcgctgttacgcgcatttaattacggcgttcctccccatggtggcttcgcttttggccttgatcggctcattatgattttaagaaaaacgaattcgatccgtgatgttattgcttttccggtgaattcaaaaggtttagacctattgcttgattcaccaactgaaattgaccaaaatttacttgctgaatttggtttgaaggatataggcaaaaactaaattagcaaaaaataagtaaaaattattttttttggtataatttagaatataattttataagtagttgggcaaaaatgatatatgataaactagaaaattttgataaatattcatttctaaataaaaattttgctaaattagctgtttttttaaaagaaaataatttaaatgaaattcctccgggaaaaactcaaattgatggtaataaaatatttgtaattaatgtcgatgttacaagttttgatgatacaaacgcgctttatgaatatcatagaagatatgcggatgttcatattgtccttgatgaagaagagcaatatttttttgatttttccgagaaattaataaataaaattagcgattattctgagaaggatgatgttgctttttatgcaaaagattcaactcgtaatttaataaaaccattaaaaggtgaatttttaatttttctgcctggagatgcgcatttaccaaaatatactggcaaaatcagcacaatccgcaaaatgattttcaaggtagaatattaaaaaggaacattttataaacattttagtttttttaaaaaacagtattttattgtataatttaatatataatagatattaactaaaattattttgtttttcaaaaaaaaaaaaaaaaaaaaccgaaaaaggaaaaaaaagaatggcaaatattaagtcaaaaattaagtcaattacaaaaatgcagaaggctcgcgcaaaaaataatgcaattaaatcccgtgtaaaaacagcgatcaaaaaagcgaaaattgccataagtactgatgcatctaataaatcagatttgatagcaaaagctcattcagaaatttcaaaagcaaaatcaaaaggtgtttttcataaaaataaagcaaacagaaagatttcaagactaaatctttttgcaaatacttacacaacaccagcccagtaattaaatttttttagtaattttattttttggttaaaaatttaaaaaatattaccaacaaggtaatcttttttaattcactaatagatgataatgacaactaaaaatgcaaaaagcattttattttatagtatttttagttaccaagtcttgatttttaaatattttaatgtttaaatttagcgataaatttattataaactcaaaaaccaagaaagccaaagccaagaatcataaaaataaaaagtgggattattcaatatcaggttgtttttttctgaaaaatattttttgtttgatcgcctttagctaaatttgaagcatttaaatttggtgaaaaatctgaattaaaaacagtgagctctttttttccaccaatttgtgaagtgccaggttccaaaatcaatgtggccttatctaagtttggattagctcgaaaattgttagcaatttgagctaagttttgaatataaagatattttttagcatcaatttcttctggtaaaagtagattatagacatgatcccttaatgcgttttcgagattttgactattttttgcaacagaaaaactaaattgcgttgcacgtatttgacctaaattatgaatttttggatttgttaagcttccgacaatattgactaatttaattgtttttccgccataaaattttttattagaatctggctttatttttagttctagatcccaaactttatgcggaatctgctcactttcttctatatttttaactactttttcaacaatttcatcgaaatttatgataataaaatcagcattaaatttatatttttccttagttcaacttttttcaatttcatcaagaatgaatttttttgctttttcaggattagaaactccagctaaatttattctgctaatatcaagtttttcaaagatattctgccattcttcaataatttcacttgtttctggcaattttctaagtaaaataaatggcttttgcagaaaaaaattgttcttaaattcatcttttaccttaaaattcgcaaaaatcttattatcttcttcttcaagaactatatcaactttatcaccattttcttgagaataaaaataattgataatttcggcataattatttgtatttttttcgccacttaacagattaattttgtcaagtttaaagtcaatttttgttttattttcatactggtctgtttcactaatatttatatttttaaaagtgaatttaccatcatttttacctaataatccattttttttctcatttttatttataatatttatttcaaaattaaaagttccatcttgattctcaataatattttcaatttttagctcattaccagcaatttcatcaatatcacggatcattatttttaataaatcagcctgcatttccggattaatttctaaaattgtattattttttccaagtttaaattttgaattttgtgaatttcctattatttttttctttttaatcgctgaaatgatccgattttttattaaattacttgagtctaatttagcattaatttttttaattgcttgttttttaactaaattctcaatgaaattacgccaataaagcaggattttttcataagataattttttaatatcatctcaggacattttttgcagcattaaattttgtgataaaatttgtcctacttttgattcccaaaacggaataattgctttatttggaaaaatttgactaaaaagttgggaatttgagttctcgccaatcgcaactattttatatgaagatgttcccttttcaaaatttgaactaaaaagtcaaattcctgaatttgaaaagtatttatttgtactatttgtaatatcaaatttttctgatttatgatcttttttgcttaaaagttcaaatttttcgtgattattagggttaattttatatctatatgatgaaattttttcattttcaactgcagaatttaaggttatattcgctccttttccactaacacttccttcagcaataaagccaaaatctgcattaaaacctgattttaaacgtgaaacctcacttggaagctgggcaaaattactattttctggcaaggaatcaaaattattgccagttgaaactcaaagaatttccttcttagtgccagtttccttatcaattaatgggtcaaatttagggttttttattttaaggcctaattgatcatatactagatttccagatgcatcttttagataaggttcaattaatttttgttgttctttattattttgtggatctcatgcaaaccacttaatatccattattgaattggccgctttgattacaaattcaatttcatagaccgctattattttggaattatcctgtgttttatcacttttttcaaatttttttatttcaactttgtacttatttattgcgttttttttatctttttggtctagtcttagatcttcaagttcataattgaaattacgatcaaggacatcaattggcttatcatttacatataatatttcattttctttttcatctgcaaaaaaatttaatttaattttatcatgatattcccattttccaccataaatatagtcaaaattttgctttctttccttattttttgcttttaatatttcaattggtttatcaatttttggtgtataatccttttgttcataaatttttccgggaattattgttagcctttctcaaaatttatcttgattttcaactatatttgttaaaaaattaatatttacattatcttttagtttaaaatcatagtaatttttatcgtctgggtgttggaaatgcagtaaaaattcgatttttgtatcacttttgatattaaatttcagtgatgaattatattttttttgatctttgaataataattttgaatactcttcggtttttttttgaatctctccaagtatttctgattttggatttagagaaaaattccgaattccattaccattttcatcattagtactaacaggtaaaataattttgttattattaagaacttcattatcaaatttttttcttagaccacctaaatattctttaagttcagtatttaattttaaaaccggtttttgatattgatagttaaatttaaaatttatcgcaaaatcctttatttcattttccattatttcaaaaccaattcgataaactatgtttgaaattcgaaaattattagctccaaaatttttttcaagtctactaaatttttcttttatgtctttattcaaactttctgatatatcaaattcgtattttatatttgtactttttctaattcctgcaactattagggaaattcgatcaaaaattgacttatcatattcaccataaagattaaaaattgtttcctgttttcagtttctaaattttttttcatctctataaaattgtcaattacgacaattttctaaattagggcaatattcaagtgcatatttttcttggctaatttcgggttttgaaccgggtaaataaattttatttgctatttgtttatcaaatcagtatgattctagtttacgaacttccttgcttttgttatagtttttatccttaattcactcaaaatatactgaatttgcatttctatcaacttcaaaatttctaattactgctgtaaaacttgcagattctgattttgtaactggatttactaattcattaatttcaaaataatcattatttttttgaaagctaattgataaaaaaggcaacggaattaccgcagcagttaaaaaaaatggtaatttttttatcattaattttcctccttatttgatttatctcctttatcaaaaaataattttttctccattttgttaaaataacctgagcaaatataacggtcatttaggtttgaagaaaaaataaattcgccaatttgagaaagagcaataaattttttctcttcattagtaagtccgcctgaggaagaaaaaagtttgtcaactttttcaatatcattgctctttaggttaaaaaagaaagcatattggcagttttcaataattgcctcagattttctagcagcttcaccactaattgcaaaatcacccggattttgcgtagtaattattaaagaaccgttgtatttccggatagtttttgcaattttgaataaaaaatcaagggcaattgtattggattcgtcaataaaacggtgtgcttcatcgacaattaatacaattttttggtttttatagaaattagttgcaatttttccttcaataaatgataaaacaagaaaaaaagcagattggtaaattcgtttttccaggtgcatcaaagtcgagacattaaaaattaccaatccacgtgagatatctaaatttgtactgtggccattaaataatcggtttaatttcccatattggttaaattcatagcgcaaagttgataaaataattgtcttttcaaagtcggtaatatagtcaaaatttaactcttgaaatttttggattaaatcagtaattgtagggaatttatctggttctaaaaggcaaacatcctcaaaaagtacataaaaaccgcggtttttatacatttcattaatagtttcaataactgccatgaccattttatgttctaaatttggtagtagaattccaaaaaatttttctaaattttgcaaatgaagggcaattgtttctgaattattaaaatcttctgcttcttcttgttttgattggggattgaaaaccttttggatttgcaagggattaaaaattgttagatctcctccaccaaaattaattcgatttgcatttaaattatcaccaatttttcaatattcattttgtggatctaaaacgattacggaattattgattgccttattatatgttagtaatttttttgtcatcgttgattttccagcccccgaagttcctaaaataaaacagtttgaattttttctgtcttgattttgccgaaaaagatcaaaaaaaaccggagtataatcagttttgctaattccgatgatattataatttccatcattaaaatttcgtgaggtaaacgggattccaaaagcaatattgctagccggcatttcaatttcttcttttaaaaaattactaaaacgaaaaaaaagtgatgcaaaaccttgcaattgtcggtattttaatggattgatagttgccccaatatttcttagattattccgattttgactttcaatttcttttagttgattttttgtctcagcggtgtttaaaaaaataaaagttgaatagaaaatttcttcccgtgatgagccagcaatgctgattatttcttcaagagcggcacgttctgtggctgtttttgttttttgaacaacatttttttggtcattaaggtttgattctaaattttttgcccctttattaaaactattttctttttcggtggcagttaggcgatttagatgccaaacaacgctactgtttgtcgaaaaaagttgggccgctcagccaagcggtaaattaaatggatattcattgatactttgaactgaaaaataaatatcattaatcttaaaattttctgggtatcattcaattttattttgagctaaatatttgctaatatcatcgccatttctgatgttattaaattcttcatcatttaaaaagtcgttaaaattaataatttttaaatttaaatcaagtagatcacgcaatggtgcaattcgtgcacgaaatccagtcgaagaaatatttgcacgcagaagacttacctgttgcaacaaggaaacatcatttttttcatagacaataataaaatagcggtgatgtaaatatgtatcaaaattagcaatgtcatttttatattccaagcataaattttctcctaaattttcaagacattcatcttgataccgtagaaaaaatagtttattttttgttaaatcattaggatgagcaatttttacaattgaaattcgattgcttattgcattaagactgacagttagttgctggagaatctgttcaattttttcagttccaatactgaaaatatcctgaccattaatctcaatccctcctacaaacccgccaccaactttgataaaatcctgttttgcacgcgtatatggtaataaatttccggtatttgcactagtttttgaagtttttgtataaatttttggccgcgaagtgtataaaattatatatcaaagaattttataacccttaagacctcaatttttatagtgttttattaacggaactgtaaaaataaagaataaagaggcagaaattaaaatttttcataaaataaaaatgtcttctggcaaagcaaaactgatgctagctgaaataaaaaacataatcataatgattggtaagtcaattaaagtgatttttcgaaaaatttgaatttggacatttttgattcgtttattctgtaatttcattagtttttccgttttttagctatttttttgcattatttatcttttttatcatcaataatttctgatttcatattgtcattttcaggtttaatttgtttttcaaggtcgttaatttctttaatttctgattcaatattttcttgattattttcagccttctttatatcaatgttattatcctgattttttagttctattttttctgtttgatttacagttttttgattatttgtagtcgaatctagttgattttcggtcacttttttcttttttccacgtggttttttctctttttcttcaactgttttaacctttttttctttttttggtcttttttctagttctacttttggagtttttttaacttttttagtcatcttttttgttggtttttcactagtttccaccacttttgtgcgaggttttcgtttagttttcttttcctcttcaggtaatttgcctcaaaatcattctcaaaatccttgtttttttggttctacaaccgcgttttcttctaatttttcagttttctcagttgataattcagttgtagtaattgttttttcagccgatttttcagcttcttcaactatttcattagtttctaaatcttctttttggtctaaaatttgtgtttcagatgtatttttaaggctattttcctttgttttttcagatttttcattattaactacacccacttcttccaatttttcttggttttcttcgtttatttgctccacttcagcactgttttggccactattttccaattttgtctccacagagttatttttttcgttggaattttcagtgatattttgcccagatttactattttttgctgtttttggtttatttttcactcttccctcttcttcagtctcactattagaactatcagattttttattttttctaaaaaatcgaccaatcttgtcgataaaaagtttcgttggaccgtttttgtgattaggatctaaggctctttttgctcgccaatttttgaattgttcatacttttttttagcatattttacgccctgatatcccattgctgaaccggtagcaagtgttgataaagcccccattattgatggtcctcgccaatttgttaattttgaattacccggggcaagcgagttatcaacaacattgaatggatttttatttttatttttttcaaacaaaccactaacatcaagtttatcatttttaccatttttatttagaaatcctaaaacaccggcagctccggcaattccaactgctccaacctttaatgttgatgaagcaagtctttgttggtgatcaactgctccttcttgaccaaattgtgaggcaatttggcgggtaaaggcagcgattgccaaaccaccaccgataataaaagaaattctgattaaaaatcgaaaaatttgcgaactagttacttgacttagatcaattaagtctgcaatttggtatgttgatccaacccaaattagaaacaaattaaaactaatttggtagacaataattattgcaaactgtcctagaaaatttttagttcaagtctttagtctgcggccatcatcccagatacttgtcattgctcagacaggcattgtcaaaaaattcataaaaagttgagccgatgaggtaaaccaagaaataaaacttatccctaaaatgtatgcaataacaagtgaggaagccgaaagtgtgataatcaaactaatcgcctcaccggattccattccggaaaaagttgaataactaggggaaccataattttctgagattcattttatttcttcttcaggaattttatcgcttgctgattttagcatcacagtaattaaattttgatcgccgcgaatgtgttgattaattaaaaaaagtgttgactgaattgtaataagtaaggcaaaaaaaatgattggaaaaaggaaaataaaagcaaaggaaccaaaaccaactcttcccattgcaattatttcactatcagctgacctttttcgaattattaaaaatttaatatatcgtagaataaaaacgataaatcccattgaaaccgatgtgatggcaaaaattcaaaagccaactggtaaattttcaaaagcaaaacttttcttttgaaaaattgcatttacaataacattaattccgatttgatcaaaaataaaattaaaaaacgcaataactgataaaggcagataaactagtaaatatcaacctagtgtaaaaaaagggtaagtaattaaactgactagaccactaaaaagtcagccaaacattagccttttgcccctgaagccgccgagctagcaactgagattattaccgttgaaagtccaagggcaactaaaatgattataaagccgattgaagaccaaattagggctttttttcatttatctcgtttttcaacatcatgtgaaattgctaacattgttgcaaaaaaaactacggatgcaacaagtatcccagcagcaatcggcattccgatctgtgttagatattttattcatttttgtaaagtggtagctaatgttgatagctctgcacccacttggacatcctcaaataaacttaaaatatacattattctcctctagtttgactctcataatagacatcttttatttcggtaattcaatttgcgccttgataaattagatcagaacaacctgtataatcgagttgatcttcatcatttttatcaaaaaagcaataaatttccttaccaaaatcaagaaaatagttaactaaattttgtgatccacctgatttccgaattgaatagacaactaaaaaattagcaagcgctgcaattaaacggttcctttcaattaatctttttttattaacattgcatcctgttggatattcagagataattaaaatatttttataatcctgaaaattctcaaaaggtcatggattttttatcccatttgccgaaacagcgataataggtgcttcatataatcggtaatattccattattttttgctcaacacctttataaccgtttgtaactaaaatatgacgcttgataatttgatctaatgatttgttaaaaaattcctgaattttactattatatttttcgccaataagcgcgctttttggatttttattttcaagaaattcaattttaccttgataaaatagaacataaggcggattttttagtacttgaaaggcttcaggatagttttcatctaatattgtaattgcttttatttttcctgaatcaagtttttcttgaagttttaaaaattcttcttttgttatttcctcttttgtttggatagcattctggattaatttataatctcctttatatttaatggcatagtaaattagactgctcttcatttcccttcctttcatttataaattaagaaaatttagtttttatttaataaaaaaaacttttaacataaaaagtttttttatgtcttttttttgaaatcaaataaaagaaattatttaaacttaagtttaagtcttatttaaaattaccctgtatttatcatacttatttttcataagaaactttaataaaaaaaataatttaatttttaaattatggtataattttttacattctaagttttttagtattaatttaagatttgaatgaataaaaaataaaatagagaggttattatgtcaaaaattactaaagtttttgctcgcgaaattttagattcccgcggaaatccaacaattcaagttgatgtttatactctagcaggtggatttggttcagcaattgttccatcaggagcatcgactggttcccgagaagcgcttgaattacgtgatacaaatacaaaatatgcagataattgatatggtcaaaaaggcgtaatgaccgctgtggataatgtaaataatataatagcaccggaaattattgggctttgttgtaaaaatcaaagattaatcgatcaaaaaatgattgaattagacgggactccaaataaagaaaaattaggtgctaatgcaattttaggggtttcacttgcagttgcaaaagctgcggcaaacgaattaagaatgccacttttccgttatttaggaggaaccaatccgactttaatgccagttccgatgcttaatgttataaatgggggcgaacatgcctcaaatacacttgattttcaagagtttatgataatgccacttggttttagaacttttaaagaggcattacaagcggcaaataaagtttttcataatttagcaaaacttcttaaaaaatcaggttttgaaacgcaagtaggcgatgaaggagggtttgcccctaactttaattcccacgaacaagcgcttgattttttagttgatgcgatcaaggaatccggatttaatcccggatttaaaggggaaaatgctgttgcaattgcaattgatgcagctgcttctgaattttataatgggcaaaaatatgtctttaagaaactaaagtctgcctctttaaataaaaaccaagcagatttagatgaaaaatttgaatttaattcagaggaattacttaattattatggtcaacttttagcaaaatatccaataatttcaatagaagatggatttgctgaatctgattgacagggttttatcgcctttaatcaaaaatatggtaataatcaccagattgtcggcgatgatttaactgttacaaatgtagaaatcctcaaaaaagctataaatttaaaagcaattaattcaattttaatcaaattaaaccaaataggaaccttaagtgaaacacttgatgcaattcatttagcacaaaaatctgggatgaccgctgtaatttcccatcgttcaggagaatctgaggatacaacaatcgccgatcttgcggttgcagtatcttcaggacaaattaaaacaggttcactttccagaacggatcggattgcaaagtataaccgacttttagtaatcgaggaatatctaaattcttatgcaaaagccgattatattggtagggaagttttttataacttaaaataatagtctaaattatgaatattcgtttaattttgaataataaatcctttgttgaaaaaaaactcgcgacccgcggttttgatatttcaataattaacgaattatatataaaaggtcaaaaaagaaatattttacgtcagaaaattgatgccttattagcaaaaaaaaacttaattagtaaagaaattggagctttttcaagacaagaaaaggattcaagttttcttaaaagccaagttagtaaaataaaaactgagatcgaaacccttgaagctgaatgatatcagcttgatacttgattaaatcaaaaaattttagaaattccaaatttacccgatgattcagtgccttttgggacttcagaacttgataatcaagtaatttcacattgaggaattccaaaaaaatttgatcaaaaatgtaaaccacattatgaattcgggatttctaataaaattttagactttaagcgagcagtaaaaatttccggtaatcgctttgtaatttataaaaatcttggagctaaattagtaaggtccttgattaattttatgattgatactcatattgcaaacgattatcaggaaattatcccaaatactttaattctctcggaatcactttatggtactggccaacttccgaaatttcataatgatttatacccattaaaggatccaaatcgctggctaattccgactgctgaggttccgttgactaattattttcgtgaagaaataattgatttagcaaaaccaatttcacttgttggttatagtaaatgttatcgttccgaggctggaagcggaggcagagacacaaaaggactaattcgccttcatgaatttcataaggttgaactagtaaaaatcacaaaagaagcagatggtttaactgaatttgaaaatgtagtaaaggatgcttcgcgaattttaaaattactggaaatcccatttcgtgttgtagttttatcaacttatgatttaggattttcatcaaaaaaaacagttgatcttgaagcctgactgccttcagaaaatacctatcgagaagtatcatcaattagttattgcggcgattttcaagcaagaagagcaaaaattcgttatcgtgatggtaaaaataaccattatgcacacacaattaatggttctggcttggcaattgatcgtctagtcgcaattttattagagcaatatcaaaatttagatggttcctgaacggtgccaaaagttttagaaccttattttcgctaattagctcttattttacaaaattaaaggacattatatcataaataaatttttaaattacagaaaagaatttaaaatttatttatttatttattttaagtttaaaggaagaataatgaaaaaattattagttattttgcttgataaattccaggatattgaacttacaacttttatttccctgattaaaaaagcagaaatttttacagatattgaattttttaaccctaaaaataaattagtaataggtcaattcggagttgtatcaattcaagcacataatcactggaaatcagatgactttgatgctgtttttattccggggggttttgcggcccaattattccgcaaggattcaaaatcaattcaacttgtgagcgagttttttgcgcaaaacaaacatatttttgccatttgtgatgcaccaaatgcaatttttgaactaaaattagcagaaaattatcaatttagttcatatccaaaccaacataattccaaaattagactaagacaagattcgttagtaactattgaccgcaattatatttcggcaagaaatgcagcaagttcggcagattttgctttcgttgtaattgaaaagctgggatcaaaagagttagctcaaaaaattagaaatggattttatctttaaatttatagtattttttcaatttcagcattaattaggtcacttttttcataaaaaattgcatggccagttttttcaaattttaccacctttttgccaaaagtagctccaactttttcaacacttcttaacgggacaaatttatccatttcagccccgattaaaaaatattcatttttttgctcataaagcggtaaaagcacatttttgtgtcaatctaaattaagaatttgatcaaaaaccatatctgaaaaaagttcctttttttcctcaacaagtttgaaaaaagcaatcgcacttttaaataaactagcctcagaattaggtttatccttataaaataaatttgtaactgtttcttttgcctcatataaatttcgtggtagaagtcagaagcctaatctttccatttgttttttaaagcttgaatcaaaaataaacgggtttaaaggtccggctaaaattgctttttcgacaagattttcttttagaatatgcagtccaatcgcggccccaagtgagtgggctacaacaatttttacttttaaatcaagtgtttttataaaatttacagcaattttttggtaattttcaacactaattttttgattattactacttttaccacagcctggaaaatcaaaggcaacaatatcatatttgcgttttttgttttgccgaagttgaaaagtaaaattatggcttgagttaaaaccatggagaaaaagtacttttggtcgattattatcttctaaaaagtagaaaatttcttcattgtcaattttaatttttcgatttactaccatttaaactccaaaaattgtatctaaaatttcataaggcagaatttgaccaaaatactcatttaaattatgaattttttctagttctctttcaagactatcacggtcaaattctttattttccaaaatttcttctatttcttcaattggcctttgtgataaaaaatcaccttcaaacttaatttttataattatatttttttcaatatttgctaagaccttcaaaattccggcacttgttcgtttgatattttcataactaaaaaatgggttggttccaaaaattcagttttttgattctcgtaattgacttatttccttgaatttttcagtatttgaaattcctatatcaaaatgattttcaacatcaactgattttgtttgatattttttttcaaaaaatgaaattaaacggtaaataaattcattatcatcaatttgctcttccatttcatagagaatgtttgttactcgttggcggacagatttaattccttttgattcaatttttagtcgacttggctttaaaacttgtgctaattttgctaaattagcattaaataaaattgttccatgatgaacaattttatttttaaaaattatctgggcattacctgaaacttttgcgccattgacaattaaatcatttcgtcccttaaattcagcttttagccctaaggatcgaaaaaattcgataattggtgatagaaatttttgataattatgattttgcttttgactaataaaggaaaaatttatattacctagatcatgatagaccgccccaccccctgaaagccgacggtagatttcaatattttcctcttcaacttcctcgagtttaatttcttcgtaaatattttgattttttccaataattatcgcatttttatgttggtagaagtaaagaatatcctcttggttttcttcatcttttagaataatttcttcacagactagtgtataaaacgggcttgtattttttgttgtataaattttcataattatctccaaaattttagttatattctaaattaaaagtcgtaattagtttaaattttgatttaaaatcggctagattttcgcctagtcgcaaattttctaaattaaaaatttgcactttttcataatcccagcgtaaagcatatccactttttgtcaaaaaaaagattaaatcttctacaaaccagaaaaaatagttcgaattatattctaatttatcatctacactcttaactgcgatttctaattgccgaaaatggtagtttagaactcggaattcaaaggataattttcaatttttactacattttttagcttcttgatttttttcctttaaaaatgaggttgacataatttttccttttatttataaaattaatgtttttattttattataatttataattataaactattaaagaattaattttatttataattaaatttattttataattttgaaagggttcttgtggaaataagaaaagattatattgctttctatcggaaatatcggccaaaaaaattttctgatattgtcggtcaaaaatttttgcttgaaagtttaaaaaatatcatcaaatcaggtaatttttttcatgcctaccttttttcaggacctcatggcactggaaagacaactgttgcaaaaatttttgcaaacgctataaattgcacccacaaaacggatttaattgaaccttgtcaaaactgcattaaaaattttaataattcacttgatattattgaaatggatgccgcatcgcataatggcgtgaaggaaattagagaaattatcgaaaattcaatcaattttccccaaattagcccctataaaatttatattttagatgaagttcatatgctttcaacttctgcttttaatgcttttttaaaaaccttagaagaaccaccaaaacatatgatttttattctagcaacaacagaagtccacaaaattcctttaacaattctctcccgtgtccaaaggtataattttctagcgctaaaagaagacgaaatttgtcaccgattagaatttattcttgaaaaagaaaaaataaaatacgaaaaaaatgctttaaaatcagtctttttattaagtcaaggtagtcttcgcgatgcaatttcaattctagagcaagtagcaacatttgggtcagggtatgttaatcaaaaaaatattaatgaactttttggtctagtaaataaggaaattcttgtcaattttgttaatgccttatttttagctgattctaaaatttcttatgaaattttagaacaaatttcatttcaaagtaaaaatttccaattatttttagaatcattaattaaccttgtaaaagaatgaattatttgaaagtcaaccaaaacaaatgaactacttgaattttatagcaattttgatttagaaaatctaaaaataagccaggattttgcttttaaatttttagaaattgcattttcaagtctaaaagatataaattttgctgatttccaaaatttaactcttgaaatttttattatgcgcatattatcgctaagtaatttagaaattagtgatcaaaataatattaaatttaaaaaattagaagaaaataaagtcgataaaagtgatatccccgaaaaaattactgagaaagttagtgagattaagtctagccctactaatttttataaaattgaggatcggcttgaaaagttaggaaaattggatctaaaaaatttagaagaagatatgcaaacaaagcaaaataaaaattattcatcaatttttaatcgaaaattagaacaaaatttggaaagaccacctttaaaaacagaggttttttccaaatcaacaactgaatttaaccaatttggacaaataggtaatccatttattgaaactgaaaatcataaaaaaattgaaaatcaaaatctgaaaaataacggtgaatttgatggtgaaattgatttttctaattcttttatgcctgaaaatggtaataaaattgatgaaaatataaattctgtgtctgattttagtgatatttcggctaatttatcagaagataagacaaattttgcccaatcctttaataacaaggatactaatttaataaatttagatacaaattttggtaataattctagtaaatttttaaaaaaaattggttcaaaagactatttgagtgctgaagaagttttgaattttatatgattaggtaaaaattttcgtagtcaaaatcaggtggaatatgaaaatttagttcaaaattgaagaaaaaatttgccacttttcgagtataatgttgaatttatggaaattgttagcgtgttaaaatatgctaaaattctctcattaggtgcaaattttgttttttttatggccgctcgtgatgaatatgaagatttattaattgaaactataaaggaaaaatatcaagtcaatgagttattattacaaatttttaacgtggaaatgcatccattagttgcaagcaaaaaccttattaataaagctaaaattttgcctaccaaaatgcggaatgagggcaaacgaattgttgcaaaaccttttgaaatccccaaaaaaacgactatttcaaaggaggatttggaaaaacttttgtttgataagtaaaatttctaataaatttatataatttattttgtaatttttaaaattatcgaaaggaccaattatgaattttcaaaaattattaaaacaagcacaaaaaatccaaaaagatcaaaaagttaaaaaaaatgcacttgcaaaaatggactttgactttgaaaatcaaggaatttcattaacaattaccggtgattttgaactaaaaaaaataaaaatttcaccaattttagtagataaagacgatattgaaacattagaagatttactatcaattacattaaatcaagcattattgaaaattaaagaagaaaacgaaaaaataagcgattatccaaatcaagtttaattatgatcaaagaaacatttaaaaatcttgctgaggatctaagaaaaatcccgggaatttccaaaaaacaagcaatgcgaattttgtcttttttggttgatgttccaattgaaaaaattgaaaattttgttagagcaatttatgatttaaaaaaaaacacacaatattgtgaaaaatgtgggtatttaaatactaatccagtttgtgaaatatgccttgatttccaacggtcttttaaaattttagtagttgaaaataccgaaatgattgctaaatttgaagaatatggaaaatatgatggtcaatattttgtttttggtaaatatgatattaaaaatttagaaaatcataatgcccaaattaaaaaattagctgatttagccgctaataaaagtgagataattcttggtttatcttcgacaatggagggactgatttttgcaaattatctcgcaaaacacgagtttttatccggccttaaaattactcggcttgcaactggaattccatttggagcaataattgattatatcgataatatcaccttagatcaagcgcttaaaaatcgacaagaaatggaaaaataaatatgtttattagttttgaaggaattgatgcaagcggaaaatcaaccgtgatggacttatttgcaaagtatttaaaaatcaaatttcccgaaaaagagattgttactacttttgaaccaggaggcaaaaatttaaaagaggcgctgcagatccgtgaatttttactaagtaagaataatcaaatcagcccttatgtagaaatgcttttatttgcaaccgcaagacgaattcatctagaaagactaatttggcccgcactaaaagcaggaaaaattgttctttgtgatcgctatattgattcctcgattgcctatcaaggttttggaaatggtcttgatattgatttagttactagtttaaatagtttgatatctgagaatacttttcctgatttgacaatttttttagatattaaaatttcaaaagcctttgaaagaatgggcatttttcgcgatcataatcgtgatcgcctggagaatagaggtgttgaattctatgaaaaggtgattaatggttatgaatttttggctaaaaaaaataaaaatttttttaaaattgatggaaatggtacttatgatgaagttttagacctcataattgatttttttgagaaatattatgcaagctgaccaaaataattgaagtagttttctttataatcttgataaaaacggtaaaattcctcatgccattttactaatttcaaattatcctaacttattagatagtaaaattaacgagtttcttgaaatttttgaacataaatacgaaattttcctatatgatattttcgataaaaatctttcaaagcaagaatttcttgaagatattaataaattatattttagcacttttgcagattctcagtcaaaaattttcatcctaaaaaatattgaaaaaacacatatatccttgttaaattcgcttttgaaaattcttgaagatccaccaaagtcaacttattttttattaattgccaagtcacaaaatttagttattccaacaattgtttcgcgttgtcaagttttttgatttactgaatttgaccgccaaaaagatcttaaaaaaaaattagatcagtggaaaaaaacgccatacaattcggtttatgcaaaaattttttcaaattttgaaactgcaattacttcaattgcgaaaattagtgaaaatgatttggtaaaatttgagtccttatttaataatctggctaaaaaaaaatttgaatttttaatttttctgaataacattttaacaaaagaaaatgcgctgattttggttaaaatgttaattttttattctaaatcaatttttttgaataaaccgaaaaaaaattcaaaaaattcaagaaaagaaacatttatgccagaaaatttcaaaaaaataactaaagtaatgcagtcctcacacaaatttttaactaccttagatcagaacgaaaattttaatgttcaaaaatccgcatttttagtacggttgaacattattttataaaaaatgtcagcaaaaattactgttttagccaccccaattggaaatttaaaggacatcagtctccgcggaattgaggccttacgtgaagccgaactaattttatgcgaggattcacgggtttcgcgaaaattattaaattttttagaaatttatgataaaaaacttatttcttatcataaatttaacgaaaattctgttatttcaaaaatttcgccgttaattttttcgggaaagaaggtcttattaatttcagatgcaggttctcccttagttagtgatccagggcaatttttaataaactgagcacataaaaatgaaattgatgttgattttttgccaggaccttgcgcatttgtttctgcttttgtcctttccggttttgattcacctctgatttttatgggtttttttaattcacgaaaacaacaaataattaagcaaataactatttttaagccaaattttagttatattttttatatttcaccgcataaattaattaatattctggaagtaattaaagaaatttatggtgataatattgaaatatttttggtaaaggagatgacaaaattacaccaaaaatatttttttggcacaccaatttctataattaatcagctaaaagactcattaaaaggcgaatttacaatggttttgcggctaaaaaatgagaaggatttgcagataaaaaaaaagaaaaataaatatcaaaaattttctaaaaataatgtataattaaaagttaaaaatatttgaggtgttaaaaaatgattaataaacatataagtcaaattctctataaccgtgatcaaattaaagcgagaattgctgaaatcgggaagtggataaatgaaacttataaagattctaatgaaattgtttttataggtgtgcttaaaggttcgctaatttttttaactgaattaattcagagtgtagatgtggattcaatggttgattttgtgattgcaaaatcatattttggtgggtcagaatcaactggtgaattaaaagttattacagatattgatattcaaatccaaaataaagatgtaattttaattgatgacattcttgattcagggataacattatcaaaaattagggatcatttaaaattaaaaaacccaaaatccttaagggttattactctttttgataaaaaggtaaaaagaaaatacgatattcaagcagatgtttctggctttgtagttccggatgcttttcttgttggatatggtcttgattatcaggataaatatcgtaattgaccttttgtagctatttttgatcctaataaatagtaaaaaaaaaaaaaaaaaaaaggtaattaatgataaaagtttccgatgtttgctttagttatacaaacaacatggaccagcttgtgctgaaaaatattaatgttgtttttgaaaaaggtaaatattatgcaattctagggcataatggttcaggaaaatcaacgttttctaagattctttcaggaatttttaaacctcaaaaaggtagtattgaagttgatggagttttactaaataaggaaaatttaacgaaaattaggaaaaaaattggtataatttttcaaaacccagataatcaatttgttggggcaacggttgaagatgacatcgctttcagtttggaaaacattaatgaggatccaaaaaaaatgagtcaaataatcgcaaatttagctgcaaaagtgcaaatggagtcatatttagaccgtgagccacaatttttatctgggggccaaaagcaaaaagtagcaattgcatcagttttagcactaaatcctgagattataatttttgatgaaataacttcaatgcttgatcccagaggtaaatatgatgttgttaaaattcttgatgatctaagaaaagataaaacaaaaactttaatttcaatcacccacaatatgaatgaagcaattttagctgatgaaattattgtttttgcaaatgggggaattatcgctcagggggatccaaaattaattttaaatgataaaaatatcatcgaaaaagcgaaaattgactccccatttatctataaaatttccagcgcacttaaattagttagtccaacttatgacgaaaatgaattgctagagcaactatgaaaattaaagcaaaaaacatcgtaaaaatttatgatcaaaaattaccatcagaattaaaagcccttgataaagtaactactgaaataaatcagggcgagtttattgcaattattggccaaactggttcaggaaaaacaacttttattcagcatatgaatgcacttttgctaccagatcaaggcgaaattgagtatctctattttgattcaaaaaatcaagaaaaaaaattagttgttcaaaaaccgcgtttttttagaaaaaaactaaaatttattaatgaaattcgtcggcgtgtgggcgtcgtttttcagtttgctgaatatcagctttttgagcaaacaattgaaaaagacatcatatttggggctgtttcaatgggaactccaaaaaatgaggcaaaaaaaattgccgcagaaataattgaattagttggtcttgatcaaagttttttacaaaaatcaccttttgaactttcaggtggccagaaacgccgagttgcaattgccggaattttagcaatggatcctgatattattttttttgatgaacccacggccggacttgatccccaaggaacgctaaaaatgcttgaaattcttgatactttatataaaaagggcaagacaatcattctggcaactcatgatcttgatagtgttttagaatgaacaaaacgttgtattttttttaaagatggtagaattatttatgatggtgatacttattcaattttagcaaataataaatttttaattgaaaataagatgttaccaactaatttactcaattttcgcgaaaaattaatcaaaattggttatccaatttctaatgttagatcagtatctgagttaatcagtgaaattaatatgctaattcaaaaggaaacaaatgcagattagtgttgcaaaatatgtagctcaaaatacaatcattcataaaatggacccgcggctaaaaattgcttttaacatcctttttgcggtacttttttttgttacaagtcatctaattacaattttaatcttgctttttgcagcattagtatttttttatattactaccaaaaaaataaagcaaatttttaccttgatgaaactgcctttaataatttttctgataatgattataatttatggatttattattgaccagaaaaatattaacataattttagggataaccgcaccagataaagcgccacaataccgggttttgggtctaaatgaacaacagacaaatgattttatttcctgatatttagtaaagccgactgttttgttttcaaatcttaagttctcaattggcactgttagcataattcgctcatttgttttggcgatccgaatttatgcaatgataatttcaacaacaattctgacctattcaaccaaaccatttttattaactagggcaatcgaggacttaattctgcctttaaaacttttatttattcccacacacattatcgcaatgattatttcaattgcaatccggtttattcctactttgttattagaagcaacccgaattatgaaagcacagtcttcacgcggagttgattttaaacacggaaaaattaaggataaagttaagtcattaattaccttgataatcccactttttgtattagcgttttctcgagctgaagatctttcaaatgcaatggatgtaagaaattacgatgtttatgcaaaaagaagtcgttatcgcaggctagtttttaataaaatggattatttatttgccctaatttttattagtttaattattttaacagttttaatggaattaaatataattccaatttcgcatctgccaaaatgatgattatacactaatcaaaaaatttaaattatgaaaaaaaacagtcaaattcgcgcgaaaattattgaactaagagaaaaaattgaaaaatgaaatcaccattattaccaattacagaacccacttgtcgatgatttagtatatgataaaactttaagagaactagaaaaattagaacgcgaaaattttttcttatttagtcttgaagaactaaatcaatcaccaagtcaaaaagttggatcaaaaattacctcaaaatttgaaaaagttgctcattcaagtccgatgttatcgcttaataaggcttattcaaatgaggaattggaaaaatgagcaaaaaaagctagcgaaattcttaaaacagttacattttttgttgagcctaaaattgatgggattgccctatcacttttttaccaaaatggcaatttgattaaggcattaacacgcggcgatggagtttttggggaaaatgttttagttaatgcacttaaaattaatgatgaatttattccgaaaaaaattaattatcttgaagatttagaagtccgtggggaaatttatattgataattccacatttgcaagtttacaacttgagacaaaaaaatttaaaaacccccgtaatgctgcaagcggaattctgcgccgttataaaaatcacaagccaaaaattgatgcaaaaagtattaaatttcttgaagaagaatccgattttagatatttaaaaagttttttttatactttagtaaaccctgaaaaacataagataaattcccaatttgatagcattaattttctaagaaacttaggttttcaagtaaatcctttccaaaaaaagtgctctgatttaaaagatgtttttaattttattagcataataaagcaaaaaagagatttcctaaattataatattgatggtgttgtagttaaagttaatgaattttctatctatgaaaaattaggctcaacttctaaatttcctcatagcgcaattgcttttaaattcgaagacgatattgcaaaaactaagcttttagcgatttttgcaacaattggaagaacaggaaaagttacttataatgcaaaaattgagccagtaacactggctggaagtaaaatttcatcagcaattttaccaaattattcttatattgaaaatttaaaattgaatttaaatacagaagtttatataaaaaaagccggcgaaataatcccacaaatcattggtagcgttcataattatccaaaaactaatttttcaatagtaaaaaattgtccaaaatgtaattcagaattagtcaatagtgaatctggacttgatcagttttgtcaaaatcaattttgtcctgaaattattttgcaaaaaatagtgcatttttgttcaaaaaatgctttaaatattgagtccttagcccaaaaaagaattgaaaaattccttgaaaaaggtttgatttcttcggcttgcgatattttctatctaaaagataaactcgaattaatctatgaaagattatctaataaaaatcaactacttaccaagcaaaatgcttctcagtcaatgcagattaagtcaattatgaagctattaaatgaggtcgagagagcaaaaaatattgatttttatagactaatttttggtttgggcatacgaaatgtgggtctaaaagcagcaaaaattctttcacgttatgcaagtaatctttcagaattgagaaatttagactttaatttacttaaaaatcagcatgattttggccctgttattattgaatctctaatcgattattttaataatcaaaaaaattctgagcaattaaattgtcttgaaactgttgggtttaattttaaaactacttttttaactaatcagtcaaattcctgagctagttttgcaatttcgggaaaattgagcaagccacgcgatgaatatgttagaattattgaggaatcaggcgcttcttttcatgaatcacttacaaaaaaaactgattttttattgctaggccaatctgcgggttcaaagatagaaaaggctaagaaagccgggataaaaatcattaacgaggtacaattttttgatttaattaaaaattctaaaaaaacttaaattaaaaaaatactataaattacgttgtttttttattttttcgaatcacaatagaagaaagtttagactatggcaattgcaataatcgctgaatataacccgtttcataatgggcatatttatcaacttgaatatacaaaaaaaaatttccctaatgataaaatttatataattttaagtggaaatttcacccaaagaggtgaaatttcccttgcagattttaaaacaaaaagtaaaatagcacttaaatatggggctgattttataattaaactcccttttgagtatgcaactcaggccgctcatatttttgcaaaaggcgcaataaaaattgttaatcagcataaaattgataaaattatttttggatccgaatcaaatgatgtagaaaatttatataaacttgcaaatttatgaaatcaaaatcaagaagcctataatgcatttttaaaatatgcccttaaattaggttattcctttccaaaagcatcagcatttgctttagaagaaataagtggtcaaaaaattgtttttccaaatgacattcttggctttgaatatatcaagcaaatagttgcaaataattacccaattcgcgcttatactttaaaaagaagtgaagaatttagcctgaaaaatcctgagccaaacattgcatcagcaacttatttacgccaacttgttaacgaaaataagtcaatttcgcgattttcgccgatgaaatttatacacccggtttgttctttggcaaatttataccctgaatttcaaaaaatagtccgtgaaacttcccctgaaaatttagcaaaaatttgactaattagcgaagggattgaaaatttatttaaaaaacatattaatgagccaaattttgaaaaatttttaaatgctgttaattcccgaagatatacaaattcccgaattaaacgagcgatggtttatattttatttagaattgaagatccaagtcaatttgatgaagaaaaaattcaacttgattgctgaaaaaatcagggtttttagcgttttttttgtcaggaaataaaaatttttcaaatctgatcaaggaaaattgcggctgggattaaaaaaagtagaaaataatgattgttatttttcagtattatcaaattagaaaaaacaaaatcttttggcgaaaaaacggcgtttagtccaggagttaaacatactaataaaattgataaaaagcttacactaaatccaagatgtaaaaattttaaatcagaaaaattatacctaataattggcttgtttgtagctaaaatataagaaagacttccaagatttaagctgataattataaaagaaattactgaagattttgtaatccaaaaactaaaaagacctaaaaaagtaataaaaattgcccaaaaaccaatttttaataacaactttttattaaaaagttgttgattttcctctagaaaatttttattcattacatttgttacaatgtttgtaagtcctaaagctatcccaccaaaagtttccgagacaacgttaattcaaagaatttgcagacttgaaaaaatttgttccctgaaaattaaagtagcaaaaatcaccgataaaagcatcgtaaaattagcaattagtaaaaacgcaaaaatttgcttaatatttcgaataatatttcgtcctgttttgatagccaaataaagagttttaaaattatcatcggcaagaataacatttgctacctgttttgatacctgtgaacctgttattcccattgcaaaaccaacatcagcttttttaagcgaaggcgcatcgtttactccatcaccgagcattgccacaacttgtttttttgcttgtagggcgctgataatttctagtttatcctctggttgagatcgtgaataaaggtgaaatttttcgacattttcttgtcaaaagttgtcttttttccaatttgatgcatcaacaaaataggaattatctttaataattccgacattttttgcaattgcaaacccagtatgaaaattatcacctgttatcatcactgtcgaaatttgcgattttgtaagtgagttaataattgattttattttttttcggggtgggtcttggaaaccaatgaggcccgaaattttaatatttttaagatatttttctaaatttgaatcaaaattttgactattactaatttcgagataaccaaatgcaaaaattcggtaacctaatttttgcatttttagaagtttttcatttaaattttgctcaagattatcagccattttaaaaataatttcaggcgcgccctttataaaaagaaactttttcttgttaaattcataaaaaattgctgaaaatttccgctttgaactaaaaggaattttatcaaggaatttatattctttttctaatttttctttttcaatttcaaagttttttgccgtttttaaaattaggatctcttcagggtcaccaagaaatttttcaatatctccttgaaaaaaactataggcacttgtatttaaaactgcctgttttcaaaaagttttttgctcaatttggtaatagaaaatatcagttatttccattttattttcggtaattgtccctgttttatcagaacagacaatcgagactgctccaagagtttcaattgtctttaaatctttgacaattgcattattttttgctaatttttttattccaataattaaatttatgcttacaagtgggacaagtccttcgggaataaatccaattgcaagcgaaagcgagactataattccttctttaaaatggctaaaatcaccagaagctattagaaaaatataaacaaaaaagaaaaaaatcgctaaaaaagctgcaataaaagtgataattttaataaatttttgaatttttttctgtaaaggtgagctagcttcttctgttttttggacaaggtcggcgatttttcctaattttgtttttgcaccaatagcagatactaaaatttttgcatttccacttaggacacttgagccactaaaaacttggcaatcctgattatctcagtttgtcattttttctttatataccgaggttgactcgccggttagaattgattcagagactgcaaaatccttcatttcaagtatataaccatcgccacttatgagatcgccagcgctaacttcgagaatatcgcctactaaaatatccttagaattcaggcttatttttttaccctgacgaattattgtcgaaactggtgagttaagatctgaaagcgctttgattgctttttttgattttgcctcttggataagtgaaaaaaatacattaattgtgataataattccgataattacaggctcaagataagaaattatttttgatcaaaaaggcagatcagattcaaaaattagactaatcaaaatcgagataataattacaaaaattaaaacaagggtaagcggttcttttaactgatttaaaatccgaaaaaacaagcttttttcgccaacttttggtaagctattttgaccaaaagttgtttgtgaaaataaaatttgttcttgatttagccctttttccctatcaacttgttctaaaaaaggtaataaatctaaactttttgcattattttcttgattttttactttttttgacattttagtccctttttttataaaattgtataaattagatataaaataaattactattaggttataattataatattattttaggtttaaaaatggaaattttaataaaaaataagcgcgccaattttgactatgaaattattgatagatttactgccggaattgttctatttggttgagaggttaagtcaattcaagcaaaaaacatttcgcttgttggtgctttttgttattttaaaggtcatgaactttttctttcgaatgcaaaaattagcgaatataaaggttcgcgtggtcaaactgatcgaagtcgtaaacttttaatgcacaaacacgaactcaaaaaaattctaaaagaaaaaattacaagaaaactagcaattatcccactttttattggccagaaaaatcgaaaaattaaactcgagattgcacttgcaaaaggaaaaacaaaactcgataaacgtaatttgattaaagaacgcgatcaaaaaagggaggcagcaaaatttttaaaaaattattactaatttttagtttattaccgctattttcaatttcaagttgttatgatcttttcactagctccttaaaagatgaaaatactatcaaagatggaaataatccaataaaaaactttcaagttttcgaaaaaaattcattaattcgcaaaggtctaaaatatacaacttttgtacaagatgtctatgatggtgatactttcactgataaaaacaaccgtcattttcgactttttgggatagatactcctgaacttcaacttcaaagacccaatccaagaataaataaaaaattaatgaaatttcacggtctacgggcaaaaaaaatacttcaggatttaattcttgaccgttgaatttcctttgagatcgtaaataccgatccatatcatcgacttgtagcaatcattagcaatgaaaatggtgaaaatattaatctgaaaatggtagaaggtggttttgcaattaatcgttatagtcaatatgaaaatcaaaaaaaaaattattattacccggaataccgcgatttaattaatgcattgcgaaatgcccaggaaaaggcaaaaaacaaaaatttattactttgaagggatggaattcttccagtttatggaataaatccagtgctaaaataaatttctaattcatttctaatttaaaaaacactataaaaacaagtgttttttaaattagaattataaaaatagaactaataattttgtctaacaaagcaaagttattagttcataaatttttgaaaaaattttattttatatatgctttaataaaggcgtttcttatttgatcgcgggcaaaatttcttgtctttgttgttaattctggatcgttataaactgctattccttttaaaattatgctgctatttttgttaattttttcgttgttagaaccatttttatccgttgttttttttggatttggcccaatttgggcccagtcaagatttagataattcggaaatggtgaccatttttgacttactgggttaatattatagatagtttttccatttaaattaagtgatgtttttgaatttagctgataatttgatgatgaaaaagcactaatttcaattgatcacggagttttgataatttcaaggacaatatcttggtcatcttcgattatttctttacttttttcaagtaaaaaaggactagaatttcttagttcctggcgataaaaacgattttcgccagttcgatttgcaagttcaactatggctagattgtctaaattttgatttatttcagcgctaaaattttttattggctttcaggaattaggcccaagaattactgcttgcttatcaattaattcaggtgggaataaattagctaaggaataaaggctttttttgttctggtacaaatatgactgaaatgatttaaaattttttatctgtttaaagtcaagtccgataaaataaccatcaacttgtttttgttgtgtttcatctttgtttttttggtctaaattttcgggtttgataaaggtaatatccgaattttccgtagttttttcagtttttagtcctgcaatcccttggattgtggtatttttatttataaatttaaaatttttaatcttttgaataaaaagaccgtttccatctgagtctgcaagtaggtaatgttttttatagtcattgatattttttggtttaaatgctaaataaattagccctgaatcaagccgtgaaaatggtgctgatttgaaacttgggctacttatattgactgttctggcaatattttcttttgtttttgattggttttgctgaaatttaatcggatttgttagtttaaaaccttcttgagttagttgatttttactatctaaatcatcctcaaaatgaatattattatcagataaatctataatttcatagccttttttattgtctgattttgaaaaagatgacttgccatcaagaaaaaaagttggataaaatttagctgcatcatcaaaagcgctcatttcagaactgacaatatttgaaattttaatctttcttgtggctaatttttgcttatttttatttgaaattagactaaatttgatagtaaaatcaccttccttattatcaaggataaaatcagagcttatatcatcatttattaaattacgctgaatattaagcacttttcaaattgcttttcctaaacttttttcattgttttgtgctttattaacctgatcatcactaaattcttggactttaactagttgatttttaaggattttagcagttcttattaattctcttttataattttctatagcaatttcatcaccaattttgccaaaatcaagtaaataaagttggctaactaactttatatcaggattttctgggtctaattcattgttaaattccttaattttatttattatatttactagttttttactagttcacgctgctgaattttcatcttttcttagtaagaatacctcagattttggctcgggtagattttgtgcaaaaatccgggcatactgattcaggtctggttttaggtcccaatcaaacttaaaacttaaaattttaattagtttttgttggactcactttgagatatcaacatttatttcaagccgaattttatcatcttttagcaaattattaagttctaaagcaggtatttcactattttttttgattttaaaatttatgtttgtgatataattttttattttattagtattaattagatgctcgctttgtacataatcaaataagttttcaaaattttttgttgttgatatccaaggattattatttttatcaacataaaatgattttgcaagtgataaattttccctaattaattcagcttgaatactttccttgagcttgattttttcttctagttccgcttttattcacttaattatttcatttttaatctctaaatcaggggttattccgttaatttctaagggaatttctgttttttttccttcatttgtgaagataaaattaaggtaatttttattcccttggtttgtaaaattaagattattatcaaaaatttttggttctaaaatttgccctttatgaataaaagttggtaagccgagactgttaactaaattatacgaacctccaagttgaataagcgcctcttcaaaagcaataaatgtttgtttttgggttttgctagttttaataaattgattttgtaattccttgctaaactcagcaaaacttaaaaaattttgcggtttaattgaaattgatgattttttttcatcaatttcaaatttagcaagatttttttcaatatttttatcagaaaaacctttaatttcaactgcttttgaaaaaatttgccgttgatcgctagttcttataaaaaatacaatatttttaattgcagttccacttgctgttgcattacttagatcataactaatttggtaatttttttggtatagtttatcaagattaattaacgttaaaaggtcaagattataaatcttgctttttgctaattcaaatgctgtactagctgataattctttgaattgattactaatgaataaattatcaaagaattttccaagattattttcaaagggattttcagtttgactaatacttaaattttgtgatttttcatttaatttttgataataagcgcgattatatgaccaaatacctaaaggaattgcagttgaaatagttataataccacttagaagcaaaatgctagttacaatttttgctggtttattaaaaaatcctttaaaattaggtatttttttcattttagacctcttaattttgtatttttatttttctaaaaattaattttttattaatttttagaattttttgttattataatttttaatttctgccttgcaataattggatttatctggctattttcatcatttttattatcagcttttaaatctttgggatttttatccttcttattaagataaaaacttattaaaaaggttagtttatccgtatttagtgagttttcaaaacttggttcaagtaaaaattttgtctcctctttgggaaattgttctttaaaataagaactaattttatcaatatttatggaagtttctttaaaatataaatctaaatcgttattattgtcattattttttggttcaggtgaatgcttatttgttaatttttccttaatttttttaaaattttcttcactgacactataacttaacaaatcagccggaacactttcaactaccttatcgaatttttcttgtattttagaattttcatcaattttttgagttgagaaatttattaaaattttttgaattgggctttgaaagaaaaattttttctgactagaatcaccaataatatagtaaaaatttaatgttagatattcattatcaacattggcattataagtattatctttttctaaatttccatttattgatttttttatgttattatcagagtctaaatttttagattctggttgaatttcagaatttttatttaagttttcctgtttttctaaagaatttaattcgggtttttttagcttctgaatttcagaatcataacgagcttttgaaatttcattttctttttgaaacacaatttgataatctaaattggtatctaattttgttcaccctaaaaaattatcaagttgactagccttataataaaaagctaaaagaaggtcggccaatgttgtgaatttaacacttgattttaggttttcctcaatttgttgtcttgtaaattttctagctgtttctttaaaaagttcttggtcttctaaaatactaattacatcagaaattgacttgctttttagattattgaatttatcttttattgattttggaagaaaaagggatgaaaaaaacccttgattataaaaatcagcgaaatgattattaaaacttaaaatatttgtagttttattatcaaaatgaacttttgaactagcttcaaagatattttctccagccaggttattaaaaatttgcgaagcagtccgattttgatttaaaagtccaaaagcctttgcaattaagaaaaaactatttgctatttggcttggttttttctgaattaaatcagcaaaaaaagctgttacatccgaaggatttataaaaaaactttgtgaatgtagtgtttttagttcaattttttgctcttgattttgtgaatttatatcaattttttgttgatttaatcgaaaatttgcaatttctgttaaactaggtaagtatgtcttaccagatcaagcccgaactttggcctcaaaattatcaaaattaaaattataccgtgataatgaatttagctgtctttctaaacctttataatcttgttgcaataataaattatcaatttcttctttttttaagggattattcgaaatgaccggttgaccaaaagttgaaataaatttattttcatgactttcctcatcattaaaaagtgaatttctccgataaattaaagctttctggcttccgggaattattagattttgaccatttttatttgatataccaaagccgccaatacttaaaaacaactctttttcatagataattttttgtgaaccaggtttaaataaggattctctaaggaaaattttatagggaatttcaattatataattatcattttcattttttaatttagcattttgttggataatttcaaaactaattccgttttgattttgtggaattagttttgaagtcggcccaaaatctagagctaaatcctcttctaataaagaattaataaccccttttatgtaattttggttagtattggcagataaaattccggatttaatttttgaaaatatgtcaaaaggattcagtttagttattattaattttccgtctttttcttcagtgttaaattttagtggttttagtttaatattttgaaaaaaattctcaacattgaaaaataatgattttttatcattagtttcaaatctaatttcaaagattttttcgctaaagttttgaccaatatcacctaacatttttgcggcttgatcagttaattttgcctcaagatacatagttgggatattatcttgtagatttacaaattgattattagttttattttttataaatttaagactaaaaatcggattttctgtttttccaattttattatctttcgattcgcgtgcttgtaaaatcaagttagataattcagggaaaatttcatttattttgacctcaacctcgtttggattttcaattttattaacttcttgcgcaaaatcaattgctctgtataacttttttaatttttttttactagtttgatcagaaaaatttgtggtaaaattacctatatttaaaatattttcattaatttggcgaaacattttttgaagaacaaagttaaaatctgcttttaaaaatttatttgattcataaaatgtaattggttggctgaaaaaatccgaatatgcatattgattatttttttgtttttgcctaacacgaaatttaagattaaaattttggtttaaatcatcaaattttaaatcactaaattcaaattcaatagaaaaaggatttgaatcttttgagaatttaaccaaatcattagaatttttatcaaaaatataaaattggagatactcttcaagatttatttcttttttaagctgatcaccggaaaacaatttttcttttatttttcagaaattactatttttactaatttgctcaggtttaaaactaacaaaactaattttttgtgcaaattcattaacttttgcccgcgggtgagaaccattatatttaattgttaaactaattccgacagaagtagtaaataaaattaacccagcaaaagttgaagctagtaccaaaattgcttttttatttttgataaatctgccaatcaaattagcctgcattaaaagctcacctccgcgaatttacaatttaattaaaattataccatattttaattttttagtaactaaaatccgaaaaggattgtgattttaaccaaaaattattagaagccactaaattattcaagatctaaacttatagtttagaatttttttctataggataatttaggtgatttcatgttattaaatctgattaatttaaacccgagtaaaaaaaaaaaaaaaaaaaagttaaaaatcaaccttgaatttctataagcaagtataacttgaagacattaaaagttataaaaaattgtttatttttattagctaaaaggtaaaaagttgctatttttaaacatttttttaaaaaaatgtaggaattttaaagtatattttttgaaaatttttacctattatagtataattgataaacattataattaagtaattgaaataataaaattttaattcttaagaaaaccaacatttagaatcgagatttaaaaaatatgccatattcccttaatttaatttcaagtttgctaaaaagaatgacagattttctaactatctttggttttaaatatattaaatctaacgaattaacaacttttgagtataattttatcaaacttaatattgactcaaaacatccagcttttgatcctagtcagagtttagtttttagcgataatcaattgcttgcaactcataaaaccggaatttcaatcgaaattataagtaaataccctaaccaaaaattagccttttactcctatggaaaagttttccgtaatgacgaagaagatgcaacgcattcgcatcaatttaatcaactagatttagtagcaactggaaattatagtgtttctcatcttaaaagtttaattagcgacttacttgaatatgtttttgaagaaaaacttaaaactcggtttcgcccttcttactttccatttactcaaccttcttttgaggttgatattttctatcataatcgctgaattgaaattttaggttgtggacttttacatccaaaggtgatgaaaaatgcaggatttagtgcaaaaaaaatctatggaattgctgcaggaataggaattgaacggctagcgatggtcaaatacggaattagcgatattcgggaattttataaaaatgatttacgttttttaaaacaatttaggtaggtagagagtaatgcttttttcattaagaagactaaaaaaattagcaaatttagaggcttttagtgaccaaaaagtaattgatagtttaataaatcttggttttgaagttgatcaaataacaaaattaaatgaaatttccgggattaaattcggtcaaattttagaaattagaaaaaatccagaagctgataatctctgaatttgtaaagttcaatttgctgataaaatcagagaaattcaaacagcagcaaaaaatgttatagaaaacaaacaagttcttgcatttatccctggttcaaaaagtggaaatactacttttttggcaaaaaaattacgcgggcatatctccgagggaatgttaatatctgcagtggagctaggttttaataagcatttgttaaattcagaattagatcaaggtgtgcttgtttttgatccaatttttgatcttgaatctaatccacttaaggttttagaactagatgatctaattttggatataaaacttttatgaaatcgaccagatggtaattcatatttggtcttggcaaatgagcttgctgctttttttaagacagattttagtctaataaacaaggaaattagtggtaaattttattcagagcttaaaattattaataaaactgatagtaaaatttttgcccttgagattcaaaagttacctaaactagcattagttgacatttttttgcttttaaaatcagaagtaaaaattggcaatttagctcaaaatttctctaattttatcctaatttatacaggccaaccttcctattgtctccaattagaaaaacaccagcaaaaagttgaactaatagagcaaaaagttaaaataaaatacgagcctgatacaatttcaagttatcattttcttaatcaagaaaaaaaaccgttattaattcccgagttttctgatcaaataattatggaaaataatagttttttcctaataatgccaaaatttaatttgctgaaggtaaagcaaattaaacaatttttaaagaaaaatagtctaaaattaacccagttaggaaaaaattataattatgggacaacttttatcgccctatcttttctaaatttttttctagaagatcaaaaaattgacttttcctgaccaattaattttgataagagtttaatttccaaaaaaacttttcttgatttaaattataacgagcttaaagagattttaggtctagaacttagtcaggaagatattagtaaaactaatttaattcttgaaaaaatcgggtataattttgataatactagttttagtccccctttttatcgggttgatattgaattttttgctgattatgcggctgattttctaagattttatggccttgaaaaactaaaagactgcaaattagagcaagtaaaagccaaaattccaaacccggattttgaacccgtgaaacttaaaacacttggatattatgaaacaaattcatttcttttgatttcaaaagaagaaaattttaatccactagaacttaaaagtcaggatcttctaacttttccatctcaagaacatacaaaaattcgttattccttagcctgacagcttgcaaaaattaccaaatacaaccaaaaaagaaaaataactgagattagtctatatgaaaaaggctcaattgcaggctgaaatcattctttagcgcttgcttcaactatttatacaagtgaagacttaaaaaagcatttaaaaatattgtataattatgatttcgattttcttccagcagattcagaattcctcaatcccgaaaagtcacaatttatttatcttgataatgtcttagttggttgactaggtcaggttgcggaaaaatataactatgaaaatgttaattttttagagattttgctctcaaaagtggaaaaaatccctaaaaaagagggagggaaaattaaatttagaccttatgataactcccaactaaaatatcgtgatatcacgctttcactgcctatgaaggatattcctgatccttatctaaaagtaattcaaaaaattccagaaattttttcggtaaaattaataaattatgttataattaataatcaacaaaaaattacttatcgaatcacaggacctgatcaggtttgtgcagaaattgataaattctataaataatttcatttttttattgatatttttatgaaaatgaaattatttataataaaggaaagaaatggcgatagttcccaagagaaaaacatcaaaacaacgtaaacataaaagacagtcgcattcagcgctgaaattaccaaatttagtcagttgtagtaactgtgcaaataaaaagctacctcatcatatttgccaattttgcggtttttataagaaccgcaaaattataagttttaaagcagtaaatgacaaaaattaatgaattaattaatttttgtcaatctttttgtgtaaaacaaaaaaaaaaaaaaaaaaagtaagaaaaaatttgttaaaataaaaatttatagtataattattaatacttttattactatgccgatttagctcagcggtagagcagctggctgttaaccagttggtcgcaggttcgatccccgcaatcggcgccattaggcccgttggtgaagcggttaacacacatggttttcatccatggattcacgggttcgattcccgtacgggtcaccaaaataaaggaagattagctcagttgggagagcaacgcccttacaaggcgaaggtcaggggttcaagtcccttatcttccaccatttcgccactttagctcagcaggccagagcagtcgccttgtaagcgaaaggtcgtaggttcgattcctataagtggcaccaaaaataaaattatttcttaaactgcgtgtacttttgcgcgagtggtgaaatggcagacacgctagatttaggctctagtgccttcgggtgtaagggttcaagtcccttcttgcgcaccacgatgataggtcaaccttgtgttgattttttttttttttttttttttttttaaaaaaaagaaaaaaagatgattacatttttatataaaccaaaaaaaattagctccgcaaaatttctaaggcagtgatcaaaaactaatttgattaaaaaagcaggccatgcaggcactcttgatccattagcatccggacttttattggttgcaactgaagatgatacaaaattattacaatatttagatcagaagacaaaaacttatttagcaaaaattcagtttggtttttgatcaacaacctatgatgccgaaggtcaaatttacccggtggaacaggcgattaaagttactaaagacaatttagaacaagcattaaatagattatcagaaagccaaaaacaggttccaccagttttttcaagtaaaaaagtatctggaaaatcggcttatcattatgctcgtcaaggtaaacagattgaattaaaaccgattagtattaaaattagtaaaacaattttaataaattttgatgaaaagctgcaaaattgtgttataatgtgacaagtttctcgcggttgctatattcgctcacttgctgatgatttaggaaaaatgctaaaaactagggcatacttatgtgatcttgaaagaacaaaaattgggaattttgataaaaaatttttaaatcaatctttaaaacctcaagatttatttgatttgcagcaggtaaaattagatcttgaaaatttagaattattattacaaggtaaaaaaattaattattttgccaaaaacagcgagctaaacaccttaattttcaaagatgaagttgttggttttggtaaaataattaataatgtactaattacgaaaaaattgtttggcaaccgtataaaaaaaataattaatacttaaaattcactacaaaatgaataaatttaaactttttgccacagatatcgatgatacaatagtgccccatggtggtcagataattcctgatcaaatccagttattatttgcaaaattaaaagaaaaaaagataatttcaacttttgtaaccggccgtgattttatcacaattggtaatttgatagcggcaaaaaatgttgatttttttattggtgctaacggtgcctttatttatgattttcaaaaaaaagcaataatttatgaaaaaactattgggataagtgattttttaagaatagtcgaattttttgatcagcgcaaaacaccttatgtaattatgggaattaaatccatttatacctcaaattactatccaaaaatttcctctaagttcttacgaatttatctagataaaattaaacctttatctgaatgtgattttaaagaaaaatttcatatttttacaatatttgatgaccacgaaagggtatcacagattcaaattgattttgaaaattttattaatgagaaaaaacttaatgtatcggtgagctcgcgttggtcatgaggtttttttattggagcaaaaaatgttgataaaatgtcaactttagaagttttagccaaaatgaataatatcaaaacaagtgaaattattgcttttggtgattcccgtaatgatacaaggatgctaaaaaatgtcggttatgggatcgcaatggaaaacgccctggatgaggttaaggaagtagctgatgatctagccccgccgatggaatcatttggggtttatcttaaaacaaaacagttaaaaataattgactaaaatggtaaaagtttatacttatccgttagctaatttcgatttaaagaagccagtttttgtccttggtggatttgaagctttccatttagggcatcttaaactattaaaaatagccgcagaaatcagtgatgaaattgtttttatggtaattaaggacccgtcaaaattacctaaaaatacaaaggaaaatttttcagatttaaatgctcgaattcagatgatggcaaattcaggggttaaaaatatcatcctttttgattttaatactgaattacaacaactaagaggtgaaaaatttgtcgaaattttccttaaattacaagtagatttttttgttgttggtaaaaattttgcctttggaaaaaatgctagttgaaatccagagcaattacaagaattttttccaaggacaaaaattattgaacatctaaaagatggacaaaaaaaaatttcaactaaaaatttaaaattatttcttgaatttggtgattttgaaaatttgaacaaatttttggcaacaaattttttaattagcctcaaaattgatgcaaataaggaatttgtttgggataagaatcttatttgtccacccgctggattttacctcgcttatttggtggtagttaataaaaatttaaaatttcctgtaattttacaaataaaatttgcaaataaaactggaaaaattcattttttttccaaaaatgaacattttacgggttatttagaaattattaagcaaattcgttatatttattcaaaccatactaataatctcagaaatgatgatatagaaattgctaaagatttttttctaaaaaattataaaaaaaattaatgatttttaatttttttataccaaagacgtctaaattcattaaaaaattctgaacgagaactatttaatttttttcgaatttttaacgaaattagatcaccaataaaaagttgtgatactttagaaccaactggaaaaatactattattttgttctaaagtatcaaaataaactacttctgagaatgaattcttttccaaatttgtatttgaagttataaaaatggtgtttatttggtgttgttttgccaatttagtaagcgcaactgcatcgcgagaagccattgaaaccgaaaaaataacgaggcaagtactaccaggattgccaatccatgaggcaatatcggaaatattttttgcgcataggctattaaggtgtaaatttctaagattatttgaaaattctgtagcaacagttattgaagaggctgtgccataagtaataattttatccattttaagaacagtatcaacaattcgattaatttgcgaaacattaagaattgctagtgttttctcgatactgtgtacataaagcaggttaatattttcaatttggtcgttttcgttatataaattattatcctcatcaagcttaagtcattcaattacgaatttttttaattctttgaaattgttaaatccaagcttttttgttaattgtgtaattgttccgacacttataaataaggttgatgcaagttcattgatagtttgctcaacaaattttcgtggttttgtttcaataaatcggataattaatttttcaatgtgagttaatttaaaattttttgaaatggttagaacactcataatttaacaattttacactatttttaaaaatttttaaaaaaaaatcttaaaaatttttaaaatattaaaaaattaaaatatacttaacttttataggaattaacaagaaatcctttgcgccattattataacttaatttcaagaaaatttagttaatttattaaaaggtttccaatttattatttctgagacttttagtgaaaataaatttttctattaatcaaaaaaactatgtttttatagtatttttttgactattaatcaaaaaaaaaaaaaaaaaaaaaaaaaaaaccctcaatagtcctaataaataaggctaaaaatcaataaattttttgtgattttatgatataattatattaaattagaaatcaaaaattggtagaactttttgatattttttataagttatatttatttttaaggttcgaaattagtttataatattttcttttgaaattaattaaacttaattttttatgcaaaaaacgcttaaatttatagtataatttttaatttaaaggaaattatggctaaatttattttcgttaccggtggtgttttatctggaattggtaagggcgtatcagttgcctcagttgctaatttattaaaaagttgtggttattctgtttatattctcaaattagatccgtatctaaacgttgatcctggtgttttatccccttatgagcatggtgaagtttttgttactgccgatggaggtgaaacggatttagacttaggccattatgaaagatttgttgcccaaaatttttcaaaggattcaaatcatacaagtggcaaaattttactttcaattattgaaaaagaacgtagaggcttttatcaaggaaaaacagttcagataattccacatgtaatcgatgaaataattttaagaattaaaaatgtagcaaaaaaatataaaactgattttgttctagtcgaaataggcggaactgttggcgatatggaatcaaatccgttttattttgcagcatcccaaatggcatccgaatcgaattttaaggatgttttttttattcatacaacttacattccatttttaaatgcatccggggagtttaaaacaaagccggcacaattttcaattgctaagttaaattcgcgcggaattcgtgcgaatgcaatttttcttcgcttagaaaatgataaaattgacgaaaaaattgctaaaaaggtagcaaaaagcgcctttttatcattagaaaatattataattattcctaatttacaaaatatttatcaactaccattattacttgaaaaaacagctttattaaaatcaatttttttacattttcagttggaatttcgccaaccaaaattagaaaaatgaaaagaatttactaatttattactaaaaaaatgggaaaaaacagtgaaaataggtgcgctcggcaaatataccgaatttcttgatgcttataagtcaattttagaggcttttaaaatttgtgctgcgcaccaaaaagttaatcttgaattagagtttgttgatacggcagataaaaatttttctctggccagactaaaaaattttcagggaattattatccttcctggttttggctttcgcggctttgaaaataaagtagaagcagcaatttttacctaccaaaataatataccaacaattggaatttgtcttggaatgcaggtgatgacagtagcgatggccaggcttaacggaataaaaaacgcccattcagccgaatttttagcagaaaaacctgatcagataagcgttcttgattataatcaccaagaaggttcaaaattacagattggcgggacattaagactgggtgaatatcaagtaatttttgcaaaaaattcaaaaattgcaaaaatttatggtaaaaattcgtcttttgaacgtcatagacaccgatttgaggtggttaaaaaatattcggctaaaattgaaaatactgattttatctttagtggtaaagatgcaaaaaccgacttgattgaagtatgtgagtcaaaatcacatattttttatattggagttcaatatcatcctgaatttatcacgcgtccactcgatccacacccactttttaatagttttatagcagctattattgagaatgtttactaattttttattttttatttaattttagctatccgaaatagaatttttaaataaataaaccccgaaattaatgaaactaaacaagccagaattactggtgagttaaaaaaataataatagttttgaaaaatttctctactggtagaataaccagtaaaaattgttaatatggcaccaatttgtaggatagttttaagttttcctcaaaaatttgcagcaacattaacgttttttttggctaaaaagatacgaaaaccatcaataattatatccctaagaacaaaaatcaatactaaaaatcaaggtactaaggttaaataagcaagaaaaaagaaggttgttgttgttaaaattttatcagtaatcggatcaaagattttaccaaattcagtaacaacgtttcatcttcttgaaagaaaaccatcaaataaatcagaaaaactacctatgataaacaaaaaaaaagaacctaaaaagagagaaaaattgtcggttttgctaaaaaaataaaggaaaaaaccgattattgttgctgcaattatccgaaaaagagttaggaaattaacaaaataagcacggatttttagctttttcttcttcatttttttcaaaaagatcgttttatattatttggtgaaattcggtacgtttcaaaatattcatcagaaagttctaaaatttgttcacttttaattttacctttttttagatcgttaattaacgactgataatatttttgaaatttaattttttcttcattaaaaaagctgagaattgtttgatcaaattcctttaaaaatgaaaaaaaatcaaaaaaatacttaatttcatcagaatttcttttttttcataaatttgacttttttttaattaataaatttaaattatcaaaaaaaattttttctgtttcatagccagattttaaaatctgatcaacaattggatctttttcaattcttagtaaatggattttagctaaattatttaaatctgacatttttaatttactaccaactacgaagttttctactaattcctcgtttttttcaataattataataattctggctaaaaaaattgccaaggatttatttgccaattttttcatttcctctttttcagtttttaattttcttaattttatacgatttgtgataaaactataagcaaaaaaaccgataattaaagttacaagtaaaacaactacaacaattaaattagtatcaaccataacattttcttatatttttttaaaaatatattatttatttgttaaaattttggtatttctctttctgaatcggtaaacttttttagcattttcatcaacttttataaagcgacaatttgggaaactagaacagccaataaaacgctgatttgttttccgattataacgataaaccaaatcagcatcacattctgtgcatttttctccagtagttctggcttccattattaccttttcaacttcaaccgccttttctatagtattttcaatttttgatcacattgaatcaagatattttttataatcttgtttcccttgagcgattaaatcaagttcttcttcaacttgagctgtaaattttgcatcaataatttctggcgaaattatttttaaattttcatagacaattttgccaaaatcacttaaaacaagcgattttgattcagaatcaacatataaatgatcctttaatttttttactgaaattgcaaaagttgaggggcgacccactttttcatcatctaatttttcaattaaagttccatcacgaaaatgggctggcggtttcgtttgatgtaatgaagattttatcgaattatcaaaatttttatcgacctgaaattttttgctaattaaactttctatatcagaaaattcaggtttaaattttaaacttggtttttcagtggctttataatatccatcaaaagtaaactctgaataactataagaaaaaatatgatcttttataggtgttttgaaagtcaaattagtaatctttcgttccggagatctcattaaggcttgaattgttgtctggtaaattagttgataaatttgaaattcaatttgacctaaatgatatttttctcttgctagttccggacttagctctaaatttgttggtctaatggcctcatgggcatcttgatcgccagcaaatcctttaatacttttagtaaaatatttaggtccaaaatttttaataataaattctttacctttttcaataaaagtttgacttagccttgttgaatcagtacgcggataggaaatcaaaccataatcgccataaccctcataaagtttttgaagcgcatttgagacactagcagatgaatattgtgacattttcttaaaaattgtcgcctgttttagcgggataacttttgggtccttccgggttgctttgctatattttttaaaaattagataaggattttctttaatttcagcaattatctcagaaagttcttcttctgaattaattcagttgactttctttgcctcattttgttgattacaataaattgtatcaaaaaaattaccattttcgtcattaattttaacttctaaattaaaatatttttcaggtataaattcacgtatttctttttcacggtcaaaaataaggcttagagcaaatgattgaacgcgacctgctgccggatttttaggtggatttttaattttatttttcaataaggcagttagccgaaatccaataattcgatctaacattcgccttgtttgttgggaatttattaaattttgattaagttcaccagggttttccaaggcttcgagtattgctgttttggtaatttcgttatatttaatccgttggtatttatcagtaatggctaaatgttcgacaagtgaagcgccaattgcctcgccttcgcggtcggcatcggtggcaattattacagtttttgcttgttttgctaactttttaatctcatcaattgttttttttttggtcttgtcaagaacataagatggagttcaagtgttaatatcaattcctaaaccaaactgtccagttttagcaagatttgtgatatgaccgacgcaagctgtaactttataacttgaatcaagatacgatgaaattgtattaattttattaggggattcgacaataattaatttttccacgattttataaattttttaattcttttcgtttaatttctttaagacgagcagactttccagaacgttttttcatataatataatttcgcgcggcgaactttatttgaccggattacttcaactttatcaacaagaggtgaatgtaataaaaaagttctttcaacaccaacattatgcgaaattttacgaacaacaaaattggaagatagcccattttttttgaatttaattacaaggccttcgaaaatttggattctagttttattaccttcttgaatcttaaaataaaccctaacattatctcctggttggaattgaggatataaacggatttggcttgattcaagaatttcgattaattttgcttgcattttgaactccctatttttaatttgtttttaaaaaattataatggaaaattaatttattttttattttttatttttaaaaatttttctcataaatctggtcgtttttttttagtaattagctctcgctgttcttgacgtcattctccaatctctctatgatttccagaaattagaactttaggaacttctaggccgcgaaaatttgctggtcgcgaatattgcggaaaatctaataaaaaatcattaaaagtctcatttttaagtgattctgggtttattatatctggttttaaccgaataattgcatcaattattgccattgcagcaatttcgcctccagttagaataaaatcgcctagtgataattcaaaatcaataaaattatcgataattctttgatcaaaaccctcataatgaccacataaaatcgtaatttcatcttcttttgcaagctttctcgcaacgctttgatcaaatttttgtccttgtggactaagagcaattttaagaccacctaccttttcaagagcatcaacaactggctgaatttgtaaaagtaaaccaggaccgccaccatagacatagtcatcaacttttttgtgcttatttttactaaagtctcgaaaattaacaacatttattgttatttttttttgcttaattgcttttccaattattgattctctacagaaaacctcaaaataacggggaaaaagtgttaatatgttaattttcatctgttgtatttagaaaaaaaattaagctcttgatgatttttgttctagaaaatttttaaaaacaccctttttagagaaaatatttctaacggtttgagttacttgtgcgcctatatgcaatcagcgataagttttttctaaatttacttttgcaaatttttgctgtggattataatatccaagcgcttcaataaatcttccatcccgtggagcgcgggcatctgctacgacaattttgtagaacgggttgaattttgatcccattctttgaagtcgaattcttaccattttttcctccttttttcaatttttattattatattaggcacaggattattaggcacaggttatagttttctaaattataccatatttcaaacttaaaacaaaaattttttaagttatttttttttttttttttttttttttttttttttttttttttttggcaaaacataaaaaataaaattcagcaagtcgtttcccaaaaaaaagatttaatttaaaaaagtaaaactattatatcaaaaaaattccaaaataaaagtttttttggaattttaatttttccatagctaatctaactcattttcaagccccaaaaatcgtttatttcaatttttgatatattttatattgtaaaaactacaaaatttgcgaacaatttcatctcagatattaaaatttaccatcatcagaaagccaaaatttggagatgttgtttgcgcacaaacaatcaaataatgcaaaaaggcatgctcttttcagttaactaataccgttaggcccttatcataaatttcctgatttgccatcaaaattgccccagatgtatgaatttcgtcgatatgatgtcgctgccagaaccaaattttcttattttgattattttttagtaaaatttggtaattttttgtataatcgctaattcctaattccgaataaggtttaattggcctgcctaatttttttagaaaatcaaaataagcattgataaaatagtcataatcactttgtttgtaaaacattttaaaattttccttataaaatttttagctaaaattttacccagtcaataattttaactaaaaactgaaattttttgtaaaaaataagaaaaaattatgaatttttgtttaaaaattcataattttgacaaaaattcgacttaattactttttaaaaaactagcgaaaatcatatcgtaataattcagtaatcggttttttataaacttttaatgaaataaaaaagtaaatcagaaaaacaaataaactaattacaaaccaggaaatgataaaatttatgaaaatttgtagaaagcccggcgtgccaaagtcaacatttgtgattaaggtataaaaatatggcattgttccaagagtcaaaattaggccagaagtcagcataagcccgcaaataacaagaatatttaataaatggataataaaaatttttcgctttttaagacctaaagacttaagaattccgattgatttagttttaagccgcactaggtttttggaaaataagacagaaaaagttataagtgcaataagtaaaagcaactgaatccctaaaaggatcgattttatcataaaagttccacttaaaagttttatttttactcattcaagatctctaaagaagataaaatttggattttcggctttaaatcttgctaaatttttgtcaatatcatcagttctaaggaaaattttagcccctgaagggtataaagttttccttaaatcattaccatttttataaaaaatgacaagattttctgattttagttgctgatttttactaagtaattccgaattttgtgttagattaaagactccggaaatcttataaggaattgcctgcccaaattctgaatcaatcataataaaatcacctattttgatatttttagaattctttattgagttaaataatttagtcgataagagcaattcacctttgttttccgggatttttccagtttctaatatcaaatttttgacgggaatattttctaggacctcttcattttttaggttaagacctgcattcaaaacatttaataggctaatttgaatatgatcaaaatcagcaaaaaatgtatcatttcgaccaaacttttgattaattttttcaactaatttataatgaataaatgaaggaattttgcctgagacatcttttagataattaaccccggcaattattacttcaaaagttgttggatttttgttaatattcgagttacgaagtttatgaatttttactatctttccaattggatctattatttttagtttatcaataactgtttttgaaaggataatttcattctcatttttaataaaatgaccttttagattcttattatcaaagaaaaatcgttttctaaaaaaatcgctctcatcgattaattcaattggggttcctgaggaaattagtgccggttttaggacattattttctggaatctcgtaatttttatcaataaaaattagattattagtcggaaaaattggtaaaactttgacagcaatttctttttgcctttcaaaattttgaaaatccttatcaaaaaaagcaatattttttttctttgcaagttcgactgaatctaactggtattgctgaatcttttcactattaaaatttgatactttcgaatcaaggacaaaaaaaagattaagacttaaaagattaattaaaaaaaatattaaaacaaaaagcgttgaactcccccttgttttaaaatcagtttttaaaaataaaaacaatgatttaaatttatcaaataaatttaaaggtttttttttaaaaaataaatcaatttctacttgtttttggttaacttttacttgattatgtttaatttttagaatctttacaaccggttttctttcaagtgatattattaagtccccgtatttttttgctagttctaaattgtggctaattattaaaattgtcttgtttttccttaattggtagagtttttcaaaaataatttcggcattttctaaatctaaattacctgttggttcatcaagtaaaatgaaatctgattttcgcgcaaaggcacgtaaaattgcaattctttgtttttccccacctgataaatcagaaaccactgtatccaaattttccttagaaatattcaaaaaatttgcatttttaatcatattttttttgctgattttttcattacttgcttgtattccaattcaaaccctgtaaatgaattaataaggttaaaatcctgaaaaactacatcaattaaagggtttttttcttctttgccatctttaaaaaatagaatttcaccaccatcttttttagtaaaaccggcaattaaattaattaaagtagttttcccaataccagattctccggttataaaaacaagtttattttcgggaatttcaagactaaaattatcaaaaatttttcttgggccaaattttttcgtcaaatttttaatttgtaccattttttactaaccaatcaatttgatatgctagataaattgttttaatatttaaaaatggtgttttgccactctttttactaatttcctgaaaaatttcattttttatacccaagataaaattttctaacttcttataatcaagtttattttctgaaattattttaattgattttataaattcaagataaagaaacaataattcaaaaaattgcggattttttatatttttgacctcaagatttgcgtttaggtaatcaacaatttctttatcattgataaattcattttttactataaattttaaaaataaattaataaatttaaataaaaaaggtgaatttttttctaattttgcattaataacattgtttgccactgcttcagaaattgtaatttttgtttttgtatcaagaaaagcactcaataatgcgactgttttgaaaaaatagaaaaaatcaactggatttttaacaaatttagcatagcttaaaatattttctaaaaaatcattgttaagtataaacaaattagaatcgtatcttaccttaaaaaatacaaaattatataaatctaaaaagaaatcatcataattttgtgcctgctttaatgttttattaaaatagtcttcaattgttggtttcaattttgaatttacattattttttttattttcagaatcaaaaatttgatataaaaaaattgtctgtgaaatatcaggtttatttggaaataattgataatcaaagttgtaattaactaagtcttctgtttttttagtaatttcaaagtctaaattatccttattataaaaataataattaattattggtcaaacataaaaagctaaatccctatttttgtcaaaatcaagaaatcatttttttatagcattcattttcgctattcaatcctgattaggataatcataaaaatttttactaacaagataaaaagaaattacccctggaattgcaggatggtccaagtctcaaactgaaccattttttaaactttttgtaaaaacattatctcagctctttattaaaaaaataattgactcatgtttttccttaattatatcagcaaaaaaatcttttcctaaaagagaaattagtgataaaatcggagaatattttataaaaagcaaagtttgtttttttgaagtaattatgggatcttcgtttatttcagggataatttcatcacttttgaagtctaattcctgcaatgatttttttattcaattcttaatttcaaaatatttttcaaaatccaaattatttaatttaaaataagagacaagaaaatttaaatcacgaaatatagggttatattccttaggaggttctaatttgtatttaaatagtttcttatccttttggtaatattcggaaatatatctaatgagttttgaaatattattttttggttttatatttatataaagatttacaatgtcataaattctttcgaaatcatacgaaatcgcatcttgaggaatattttttaatccattaataactttttcttctaatcttttgttattgacagtttttgtaatcccaataattttattaccatcaaaataatcatattttcctaatatattactttttattacaaaacttttattgcgatttaattcttcagtttgaataaaatcatctattttctgaaatttgcttgagtaaaaacctgaaggttttgaattattttctaaaatttttgatctaaatggaagaatatcgatctcaacagttcgatttacaaaaaagtatatcaaaggaatagaaattcccattgatagtatacttaaactaataataaaaaatcaaaaccgctttttgtaaaagatcttgaatttcattggtatattttattcctgaatatcctccgatagtttttcgaccctataattatctgaatttgatgatatattaacacttaaattcccataatcagctcatgcatgtgctgattgaccaaaagttgtcaccttatattttcaaccttgaaattcataatcaagtccagcataattagaattatgtgttgttttatcatttattaaatagccatttgaatcaattcctatctttgttccggctgaagcagaaaaattcccatcatatttaatttcgccaccaacctcaaaggacggactaccaataccgctgattcatgatgttacttttaatcttagtctgtctgctgtatctctttggtaccaatttcctaattttttatatctaaatttagtacgagctattccatctcagacaattttgtcttgaaaaaatcagccgccataataagataaatattggactccagataatccgattccaaaataatagtcggtagtgtttctttcagctagttgaattacccggttttcatttgccaaaagcgcaatcaaaggaaaaagaatagcatcagcttttttcgctgggtcgctataattgttggtgtggcaatcgctaatgaaacagataaaaaaacagttccatataagaagaaattcttaattctgtgtgataatttcataaaattactccataggtttttggtttttgttaattataccactttttgggagaataaaatttgattttttaaaaaaattaaactttgttctcagtattttataatttaatcacttttataagacaaaattataaaattataaaatttattaaaaaagattttcttattatggggcagtaaaaccaaaaaactctttaaaattaagtatttttttagtttttattagactatcacgtccttaaatttttgaataaaattcagttataaaaaattatattataattgtaattataattttatctaataaatttgctcgaatttttgctaaaaataatataattaataggtaatttatgtatttttgtctttagaaaatcctttagaactaaaacaggagcaaaactatgaaggaattagagagagattaaaggatttattttcaaaatccgctgaaaacagtttgaaattcgggaattatttaacctaactagttcaaaaaaatccattgatgcaaataaagttaaaatttttgatcaacaagtcccaaattcttatccctatattgtaagaaaatccggtgataatggcactcgcggttatataatcgaagatcaaaaatttttaaatccggctaaatcattaagttttgcttatgtaacttattttgttttttatcaaaaaacaaaatattatacaggccagaatcttaaaattcttacgtgaaaaaaaggtataatttctgaaaaggcgcttttgtttattgccgtttgcgtgcaaaaatcaatatcaatatttacttggggcgatcaaaatacaactaaatttattaggaaaataaagttttttctacctgttaataatcaaggacaaatcgatttttacttaattgaaaaaatcatcttagaactagaaaaattgattattaatgatttagcggtttattcaaccaaaaaaattgatacttataatatagttattaagcaaaatttagcttaaattttctaaaaaataagtcaaatcaaaagtaaaattggatttttcttagtttaagaacaacattgtaatgatcttgaaatgatttttttagattgactagttaataagaaaaattagaattaattaccaattcgaaagtggcaaatttcaccatcttttattaaataatccttaccttcaagtcgcattttaccattttctttaaccactttttcgctaccagcttgaacaaaatcatcaaaactaataatttcaacacggataaatttttttttaaaatcggaatgaataattccgctacattcaattgcgggtgtgtttttccgaaaagttcaagatcttacttcttttttgccaacagtaaaaaaagttgctagatctagaagataaaaactatgtagaattaaaagatcaagtgaagatttttcaagtaaaaactcctttaaaaacaagtgtttttcttcttcatcgagctgggaaatttcctgttctaaagcaatacaaagcggaagtaaaattgctttttctttgactaaataactttttagttttcaaaaataaggatttgcatctggattctggattgatttttgatctaaattagcaacatataaaaccggtttgatcgttagaagttgtcaagattttatttgtaaaatttcggtagaatctaactctaaatcccttagtgatttaccattttttaaatgaatttcaactttttttgcaagttcaaattcaaatttaacttgtttatcattagtattatttgccttttttgcaagtcgggaaattattgtctgaattgttccaagatctgcaaaaattagttcaagatttatagtctggatatcaaaaattgggttaatttcgttattgacatgaataatttttggatcctgaaaacaacgaacaatatgcactaaacaatccacatttcttacatttgcaagaaatttattacccaaaccttcgcctgtagaagcccctttaattagtccagcaatatcaacaaaagaataggtagcaaaaacggttttttcgggttttactatttttgttagttgaagaattcgcgggtcatgaatttcaacagtggcaatatttggttcaattgttgcaaaaggataatttgcaatttcaacattcatttttgttaatgctgaaaaaagtgaagattttccgacatttggaagtccaatgagacctgcttttaaattcattttttcaatttagacacgggttttatcataatttccgcggatgcgatcaccgataaaaggaagaagagccacaaaacgggctcttttaactgcaagcgctaattttctttggtgttttgcgcaattaccagtaattcttgagggttgaattttgccaaaagtattaataaaacgctggagaacttcgatgtctttatagtcaatataaaataatttagcctcacaaaattgacatggtttttttttgaattttttcgcgtattttttattcattttaactcctttataatttagtcatcactatctggttcaatatcagaaagatctcagtcagcaaaaggatcttcatcgtcttgagaattgcttttattcttatcagctaaaaaacttggaaaatcagagttttgtgattcattcggtaattcttgatcgtgttcggggatttcaagacctacctgattatcatcataaataggttcaaaagttggttcagatattttttggctcaacttttgccgtctaatttctagttgttcttttgtctcaagtggttgaaatgaatcaacatttacttcataattcgtcaaataagcatttgtattattcattacccgatttccctggatactgccttcaagtgcgattagagtgccaactgtgattaatcgttctaataaagttgcgttttgtcttcaagcaacaattggaataaaatcagttattggagtagcatcttgactatatcttcgacgggaaacagcaagactaaaccgcaaaaacggtacattagattttgtatttaacaaaatcggtcttgaagaaaccctaccaattaaaataactttgttcatcgttgttaataataattttagtttgaactttgtggttttttattattgtagttttctttttctttttgattaaattttggattttttatgggttgatattgtcggcgatttcgctgagtttgactagtttgattttggtgatttttgttattttggtgcatattttcttgattatgtcggttattctcacgatgataaccgctttgattttgttgattttgcccgaaattctgttgattgctgctcacttgttggaaatcatcttgattttgcctgctattttctcgatattgactagcttgattttgctgattttgctgaaaattctgttgattttttgttgcttgttggtcttgttgatcaaaacgtgatttaggatttccccgaaaatttggcttatcaaaacgatcacgtctaagtgtgtattttctgttccgctcacgaatttttggttttttatttagacctttttcactatcaagattcacaattagatatcgccaaatttctcttgtgatatttgcccgacgtacaaattcctcgattaaattagttggagcatttaaatctactaaaaagtattgcgcaatttttgattttcttatcgagtaagcaagatttgttgtttcaagtttacgtaatttttctgttgaattatcaccaaaaacagttttaagcaaattatcaataattgccatttctgcttttggatctaaaattgtcataatttcgtatttaggcattttttctccttttggacttaagggttagaaaaactaaccaaggataataattaaaaagttttaaaatttctagtttacaatttttttaaatttgtatacaaattataacacaaaaaaaaaaaaaaaaaaaaaaaagtaaaatttgtgaacggccctgatattattaattctaacacaaagaaatcaaattccaaatttttttattttttttagtaattagaaaattaaatgacaattttccagtttttcttttataattatcatttatcatttaataggcaggcacgccccgaatttttctaacgaaaaggctgccctctcttgtttttccttataatatcttagatattataaggaggaaattacttttttgaaggaaatttaaataattatacataattataacatagatatataagaattacacaaatatgaaaagtttaaaaaaatccttattttactagctattttagcattataagccctttgtttttggctgtttcttgtccaacggtttaattagcaaatctgaattatcaaaaaaagaaagtaatgtttttaattttataataaaggaaaatgaaaaaaatttaactatatttaccgcaactttagtaaaaaaaactaataataacttgacttttgtcagcgcttatggtttgttaaattcaataaaacacaaaagacagcggtaaatattaaaatttaaactaaaatagtcttgttttgtttatattctattaggttataaatagaaactataggcacaaaaatgtctaaaatatataaaattagtgaagttcgtttggaatgcatattaacagaatctgctaaataacgaggcccaatgtatataaggtaagtcatagttgaaatattaaataaattaaagaaaattagactaacaccggtgttacgaagaatttcatttttagttataactagccacattgtcgttgtaaaaactataagaaaaattaaatggaatatattttttacaactgtaaattgataaaattgtcgactaattttgttattaattacttgtttttctacttcattttgacctgctagtgtattttctgcaatttttaattttttagaaagtctcaaaacattttttcaagcattgaagtaaaaaaatggcatgaaaaaaacgtaactagctgattttcaataagttttttctcttttgctgattaatctgtatattttaagagaataggaagccaaaaaataaaatggaattaaaaaatagaaaatcccaacaaagattgttataatcacaacctctttaaatttttcaaacattgtattatctaggccaaagcgaagaattaacgaaacaatagcaagtacaatcgagcaaagtcaaagaaaaacaaccaaatccttaataaagttaataatttttcatttaagtattaattgtcttgtagttcaatcattgccaattgaaattttgtctctaagtgacttagtaattaataaaattgaagtaattaaaggaataaatttaaaaccaatcgaatattgcttaacatctagcccagtttgtctaaatacttcatcattccttaaatttcaagcaaaaatgatacgcaaaaccaatgaggcaaaaaatgataatcaaaatatgctacctattgcggcttttaatcttccaattggtgtcgctaaatccaattgatttgttggtttgccctcaacatcgttaacactatataaaataataagtgaaataaaaattattgttttaaaaattgacaacaaaaaaactaatataaattttatggaattatcataattaaattttgtattcatttttaaattaattaaattacgcatatttacaccattttttaatatacacttatgaatattaattaattttccctatttacccctcaatataaattgtaataatagatgtaatttgctcaaattttaaccttgtcaaagctaatatatgcacttagacgtctaataccttcttgtactagctgatttataggattaaaagcaagattaataatactgttttttaaaagtttaacaattgctgatcgcacatctgaattgtttataaaattagctaaagaatcgaggcttgcatcattgatcgagttagatataatgtttttttcgttcatatacattgagtttaatattttggtggttaaaacgagattattcaccattccggcttcatagttaccagtagcgatatttgaataaatttcaactgcatctaaaatggtagggagttggttgaatagtgcccctagaaaatttaatgttacatcaaaaacagtagcaactccataaaggccatatcaaaatgccattggaaatcaatgatatcaagcttcttccagaacttctttatccttaaaatgatctttggtaaaagaaattaaattttcagcaaatttatttagatcttcttctgaaagatcattgagtttatttaattttacgagtttatttagttcaaatttgatagaatcaatgttttttttatcattttcaaaaacatatttaataacattattttttaaaatctcggtgcttgaaaattcattgctttgaatcttgatttctggagcaatttgtttttgttgtagtggtgcgattgaagtaaataataatggactggccaacgttgttagcattaatcctgatgaaaaaattttaaacttattcgattttataaatgagtatttcataattttcctccataagacttaaatattttgtataatttattatagcaattataccatatataagaattattataccatatataagaattatacaaacattaaatgcttaaaaaaatccttatttttactagctattttagtattataagccctttgtttttggctgtttcttgcacaaacattataattagcaaatctgaattatcaaaaatagaaagtaatatttttaattttataataaacgaaaatgaaaaaaatttaactagatttaccgcaactttagtaaaaaaaactaataataacttgacttttgtcagtacttttcattcgctaaattcaataaaaaacaatatacagcaacaagtttttgatatttttttacaacaatttagtgtgaaaaatttagaaactaaattaaaatcaaaaattagagttgaatatgaaaataaagaaaaagatatcatagttttttcgctagatataaaggaacccttattgttgagaatttcggattctattgattttcaggttctagaggattttacaaacacaaaaaatagcctatttagcttaggttttctcacgatcttaaacgaagattttaaacctaaaacattaaaaacattattttatgtaaatgacaaagttgttgaactggataaagaaaatgtttttgtccaagatatcaactacaggcaaggttcgtcaggttctcctctattttacaaaaacaaaattgttggtttgtataggggtaaaaaattaaaaaacggaaaattaacccccttttttagacttattgatttagctacttatcaacaaattaaatctgtagcttcaaaattaaaagattagaataaaaatattaattatttactaaattaatatattaatttattaatttcttagttttattagaataaatttttacccaaatagttttagcccataataaaaaaatatttaatattaggctatttttccaaagttgtaacctaataaaacttgcgactggccttgatattattaattctaccacaaaaaaaatcaaattccaatttttttttattttttttagtaatagcaaattaatttacaattttccatttttccttttataattatcctttaataggcaggcacgcccaaattttttctaacgaaaaggcattcctctttttcttttccttataattatctttgatattataaggaggaaattacttttttgaaggaaatttaaaaagtccatttcttatttgtttactttttaagctctttttgaatctatattacgtagtaatataaaaaattccaaaaaaacagaatacacaaattatatctaaaaatttaaactaagacaagattagctctatttttttgatggtgtaaacttaaattattaaaatatctatcaaaagaaaaagttgaatatttaatttttggtattaaactttactaaactagcaacaaaactttcggtataactacttgcgttttgaatgaaaaccttgaccttgcgtttgtttaactttttctaaaaactttgcatcttctgctttaattttttctattaaattattaattaaagtcgttttttcttcagctgtgtaaaacataattttttattttatattagaaatttttttaaaaagaagaaaaattttatgaaaatttaacttcttttcctttataatttaaatttattaggaataaatttttgcccaaagggggaattatggcaaataaagatcaaccaaaactaaaaaaatttagtccatttcaaactcttgtttttaatagtttggcacaagaaataaaagaaagaccggtaattatttttcacgataccgaagaaaattattactattatattaaagcccgcgatgcccgtttggataatggtagattaaaaaacccttttcaaggtgaaattttgattccaaaatcagataagcctaatactttatttacaaaagattcttatttagattgttcgcaaattttttatatgcgagacagcgaactagaagaattagttaaaaataacccaaaaacagaaatacttgattcaaaagaattagaatttgatcaagtaaaaaaaatgtttaataaaattaatgaatgtttgaaatctaaaccgccttttattgtaatttccaaagtttcttatgattcaaaaacaaaaacaactaagtccgaagttcaatatgctagtgattggcatttaaaaaacgattatgcccaagcaatagctgaagttgataatatcgaagaaattaaagaactcgaagaactaaaaaataaattacacaacgaaaaaaaccaattaaggttagatttatttgaaactgttttgcgggaagctcgaagagaatatagaaaagaaaaagtgtataaccctttatttgaatgaataacaaaaaacaaatttatccaaaaaggattaaacacaattgaaattattcatgaatataataagttatcaagcccattagtaccagaaacaattaacggcgatacaatttatatttgtttagttaataacaaatgggaagatagaagagattttagcttatctgaaagattagagcaaactaattttaaatctatgattgattgatttaaaaaaaatgatttggatataaatatggaatcatttaggcaatttcgtaagtcaatgcaagaatcacaagatttaggtgaattgttgtatttttataaattagaggaacagctgaaacaagatttatccaaactagaaaaaaaatataaaaaagatggaccaaaaatgaaaatgtaaaaaggagaaaaatatggaactcggtcatttaataggcgcgattttttctctagttttttggtctagctttggaatttatattaaaaaagttaagcaaacaaacaagataaaagcatttatttataaaacaacaaagcgcaaaagaaacttaacttatttttatcaataaagtaaaaataaaaaaagttcataccttacttagtcaaagtatttataaatacaaaaaagtagatccgcaaaaagtagaaccagatttaggccttgtatgtgattataacggactttttacaaaaaaatcaggagaaagtttaagaggaataccaagaaatttagatgattcaaattttatcggttatattcaaacaacaagtttttcacttcattttgcctcaagcgctttgatacgagctaaagcttacaatgaaaatgggttttgaattaacaaaaataattttcttgttggtttgattgcttttagcaccgctatttataaaataattgatagtgattgagtaaaaaattattctagcaaaaaccggcgatggctttaatcgttttttattagatctagaaacccaaacaagactagaacaatttttacttagaaatttattttttgtttcactaacaaatttaaatcatattcgaagtcttgaggatcctaaagataaagacaaaatttatttaaacgagttatgacttgataatttaaatcaaaagccaacattagctctaaatacattaagaaattatcaacgtagtcctgaagaattagaaattgaaaatttgtgatttagcattcttgaacatgcaagcacaactagcaattaccggtctgattttaaatatggcttataccaaattattgaagaactaaacacaaaaactttaatagacagcacaaaatcaaataaatactcttatgactatccagaattaaacggtaatatcgaagctatcaaacaaaaacttaaaaaatattatcttgaagaaattgctcctattttacttgaatatgaatttttaaaataaaataaaaaaaaagaaaaaaaaaaaaaaaaaaaaaaaccgctaagttagtagaaaaaattcagacaattagtttatatactaacttaactttcttgaaaaatttattatataataattaatatagtaaatttaattttttgaaaggaacagttttggttaaaacaagattttttagtaaatttaaagattttacttgatcacaaatttttgctttaataatattagcagctgctgatgtttttgttattgctgccccttattatttaaaaaatatcgtgcctaacttgcacacatatttaggaattcgtgaagaccaagtagcttctttgacagccattattggttgagttacacttgcaactcaactaccgggtggatttttatctaataggattagttcgcgtcgactcttatttattgctgtcttatcaacaggaattattacattttgatttggtataaccatcaaaaatgctcaaaacttaggtgaagaaagcgctttgactcaatataaaattatttgaggtctttgaggaatcacatcaactttaatcttttgaaccccactttgaaagctagtttcacagcaaaccgaccaaaaaagccaaggtcttgcttatgggattcaaggtagtgcaaatggtatagttggatttttcctagtttttgttattggtttaattattacttcaatttattatccagacaatcaaaatactaatgaaatcaatagcacaccttttgctgcttatacttttataattggtagttttttagtaattacttcatttttggttctcttttttgtcaaagagaaaaaaattgaacgttatactaacaaaattagtttagaatcgatcaagaaaaatattagccaaatttatgtctcacttaaaaattgaaaactatgaatgctttcaatttttgtaatgggaatgtatactttccaatcagtttttgcctattacttagttcaagtgttaaataatgtctttttagcaccgacaattttagttacaattcttggtggaattagaacttatggacttcgaggtttaattagctcttatgttggttactatgctgacaaatttagaagctacattctcattttagttttaacagcactgacaggaatttttgttattttaactattttacttcttaccttagctggaattcaagagcctggaaccccactatttatcttctttataatattggctacaattttattcttaattgcaggttctctatcatgagtaatggtaactcttagatttactcaagttgctgaaattgaaattggtaaaaataactatgcaagttcagttggaattctttcatttattgcgttttcaccagatgcttgattctatgaattatcaggatatattggaaaaatctatacaattgaaggtcaaacaaatacttcgcctttaggttatcaattaattttaacaatcgcattaggtgttgccttatttgggacaatttgtggattaatagtgtttttatacaatcgagctgaacttaaaaaactaggtaaaacaaattatcgttgaagggaattagataatgcctaaaaaacaattattaatagcacatcgtggttattcaggaatcgcacctgaaaataccaaactagcttttgatttagcatatgaatttaattttgatggaatcgaattagatgttcatttaactaaagataatagaatagttgtcattcatgacgaggatactaaaagaacagctggtgttgataaaataattgcaaatagcactttatctgaattatataatgatgatcatagttcacattttcaacttgagactcgtaaacaaaccattttaacacttgaagactttttagatctttatcttgataagtttgaagtaattaatgttgaaattaaaactgatcaaactgaatacattggaattgaaaaaattattgatgatttatcaattagatatggaaaagacttttttaacaaaataattttttcatcttttaatttttctacacttgaacgtatgtttaaattaaactctaaatatcgccttggttttttattttgaactaaaacccaactaacaagactaagcgaaaaaaaaattaaacaaatttgcaagtatctccatccttgagtggatttatatgacgaagaaccagcaatgattgaagcttttggcctaccactaaacttatgaactctcaaatcaaaagcccgctaccaaaaatatttagataacaaacatgtatatagtcaaataagtaattacaaatatagtaaagatattaactaaaattcaagatcaaattaaccttcaatttggcagtcttttaaaagcttttaattttggggtcccacctcatggaggctttgcttttggtcttaatcgtctaattatgattttattagaagcaaactcaattcctgatgttattgctttcccattaaattcaagaggtttagacctattactaaattcaccttcatcaataaatcctgagttattatctgaatacaatatcaaaattagcgatgcagataaagaataatttccaaaaagttgaaaaattttaaaaaataagcaaaaagcaactaatttttaccttttaaaacagcacaaaaattcctaaagaatttaaaccttgaagcagttttaaatttttaggaatttataataaataaaaaagagatttggctgaaacaatctcaaatttttttataaaaatttattaaaaatttgaattaaagcccgttttagataagcaattgctcaaaaatcaaataataatttactaaagtaacaaaaggtgaatttttgcaaatttagataaaatttagtcttaattatacaagtaaaattgaaaaattagaattgctcaaattttagcaatttaataaccggcttacgataacttattcaagaaattataaggtaaattaccgaaatagacacaaacattataagtcatattattataagtaaattcccaacttgcgttaatgagggcagcaaaatatcttgtcccattattgaggtataaatttttcccattgacggaatgaaaacaaccgaattaataaacaaaataaagagtgaaattataataatatttagccaatggtaaaagaaaatttgtcaggttttagcacttaatgctttaagaattccaattaatttcatttttgaatcgctcagatttttggcataaaacactgtttgaattagcaaaattataataaataaaactagaatagcaccaataactatatttgtaaatgattgtgtatttaatattgatttggatataccacctagagccgattgggtttcaaattctttgttgtttttagcaaagttttcaatattattagctaaatcatcatcaatattaaaatacagttttaatattgatgggtcaattttttctggcttattgttattaagattttcatttgttccattctttttttgcacaggtttgcctaattcattaaatttatgatgtaaaaagctaaaatttaatctatttaaagtagtcaaactacttataccaactacttttagatctacaactgttcttcgtaaagtagaaacggtaattttttgattgtttggttcttttatattaaattttgttgccagcgattttgaaattattatttcatctttgttttgaatatttctgcctaccaaatttttgttctcaaaaataaatctatttttaaaaaaatcactttcatcaatatagtcaacagaagagtcaaactctattttatcgccataagagaaagtaaccttaggaaaattaaaaaaaggaacaatttttacaatttttgggttattttctttaagttttgtgatttcatcagttgaaaatgctcctatttttccatttggttttttgtttattacaaccgaatctaattgatattcaatcgttttttgcaaattagtgctgctaatatttaaatttaaaaccccaaataataatgtcccaaaaaaacttgttaaaaaaagcattaaaaataaaatacttgaagtaaattttgatttaaaatctgtaattgttaataaaaaacctgttttaaattcctgtttaattttcgaaagttttgaatttttagcagtttcttgatattttaaatcgctgtttttagcaattagcggttgattttgactatttttggcaaaaatttcctcagtaattttgcttgtttcaatatagacaattttgtcggcatatttttttgctaaatcgaggttatgactaactactaaaatagttttatttttggcaatattagttaaattttcaaatacaatttttgcattttcaatatctaaatttcttgttggttcatcaagcaatataaaaccacaatcacgtgaaagtgaacgtaaaattgctattctttgcctttcgcccccagataaattatttactttttgctctagttgttcagtttttatcgacattaaatttgcattttgacttaatgcatttttgtctaaaagtttatttattacattatttcctattaaaatattgtcattagatgtaattttttcaattaaattaaaatcttgaaaaacaacatcaactaatggttttttaatttcagaaccattttcatcgaaaaaagaaatttttccactatctttttttgtaaaaccggcaattaaattaataagagttgttttaccgattcctgattggccaactacaaaagtcactttgtttgaaggaatttcaagatttagtgaactaaaaataaatctattatcaattttttttgttaaattttgaattttaatcatttttcctcaggcctaaaattaaaaaacttgtaaatttttttatataaaaataaaaaatcacgaatgtgattttagattaccttaataaagttgcgacatcttttcgatatgttttataagaaattaataggtaaataaatgacatagaaaaaaaactaattaaccaagtcaaaagaaaaattacgataatttgtaaataatcgggctgaaataagttttgatttagaattattttgtaaaattccgggacaatcaaaattgataaaacaatacctacaaaaaatacaaaaacactaataattattaaatttaatcaatggtacatgaaaatttctagcgttttgccgcctagtgattttaaaactgctatcgattttttcttaaaattagaaagatttacagcataaacactaacaaaaatcaataaagtaataccaagaacaataatcgatgcaaaaatagacataattaaggtaaattgggaggcaaagaaaaactgccttacttcatcaggtccgccagaggtgaaataataacgtttgacaccagatttaccatatttatctaaaaaatcctgaatgttattataaagattttcttgattaaaaaagactaaaaattcactaggatgtacatggttgaaaaaattttcaatttcactattaaaaattactatattctttggttcttctgaagcattattagtagttttatcagcatcaaaaataccaacaactttaaaaatataataactattaaaagtagtattaatttctattaattttccaattttattagtaatattagagctaactgcaatttcatcaaatgaccgaggtaaattacctttagttaaatttattgaatttgcctggcttgaattttgataaaaagatttgctaatagtcggagtttcaattgtcgtattaccacttgcccttcaatcactaaagtcaagagaataaaaattatctggtaaaatttcgaattgatgaaaatttttgtatgattcttcatatcccttttcatatgttgtctttaatttatttgtatgaattaaagagaacttaggctgatcataatttttttcttcaattactccaacaatttttacttcttcaaaatggttagaataaaaaatttttattttttttcctattgggtttgagatttcaagttgattaataattttctcaggtaaaataacatcgtcttgattagatataaaattattattaaatttttggcttttaataatgtcagcaaatctatttttaaaaaaatctgactcatcaacagggaaaattgggcctgttgaaacttttttatcatcataactaaatttaaatgattgtaaatcagaatatattggtattatattctctatttttgggttttcctttttaagtttttctaattcattaatatgtaaggaggcaagccccttttcgcttacgtttaaggtgtctaaattatattgaacaatgttgtcaaaattaatatttttagcagaaatatttaagttaacaaataaaactaccccaaaaatcattgctaaaaatgagaccaaaacaagaataagagtagtaattttcgatctaaaatccgcaagagataaaagcaacgcgactttcactttttggtaaaaagacggttttttatatactttattttcagaattttctaaaaaattattcgtagatttttgaagatttttttggggtttgtctttattttctattgatttaatattttctttttctacataaataatttgatcggcatatttttttgcaagctctaaattatgacttaccactaaaacagtcttattttgcgatattttaactaacaaatcaagtaatgcaattgagttttcttgatctaagttcccagttggctcgtcaagcaaaataaagtcggcatttcttgatgaacttcttaaaaatgcagctctttgcttttcaccacctgataaattcttaactaatcgatttaatttttgactatttatgttaattgcactagcttcgttttcaatttcgtgattttcaacataacgatttagaatatgatttgcaattaaaatattatttttaattgaaagtgattctatcaaattaaaatcttgaaaaacaacatcgaccaaaggattttcaatttcattaccatttttaaaaaaagaaatttttccactatcttttttagtaaaaccggcaattaagttaatcaaggtggttttcccaatccctgattttccaacaataaaagttattttatttgatggaatctcaagatttattgaattaaaaataattttattgttaaatttttttgataaattttgaatttttatcatctaaataaaccttttgctcggaattaaataattcaataggaactctgcttatatttttaggccatactatgctaccattccctcttctgtatcacaattcatcctcatcttcatcaacaacatcaggcaaaaacggatcattagattttattgagctaaactcattttcatcaagtgcataaccgcttgcgtattgaccaaatccagtaatttgatagtttcaccctgcggcatgataattaataaatagctcacccccttcctttttttcaagggaattaataagttctttagtatgagtatcaatgtgtaccgacatatttgtcatacgggtcgctccctcggtaaaaactccgctatattttgtttcaccgttaaattcaaaagaaggactagcataaccgccaattcaagaattaacagatagttttattttatctacagtattatctgtgttgttttctcatcaatatgaatttcttttaaaccaaattctagctttacccctccattcaactttgtcttgtctaaaaaaaccaccacgatatacaattttttttcggccatctattttaatatgtagctcacctttgttagtttttaattttttgtgttggcgatctcttttagcgtttaccgaaaataaagaaacatcattatttcaggattgttgattttgatatgaaaattcttgaagtttatttttataattattgctcgaaaaagtttgagcttgtattttattattaccgttattaccgtcatgcataacaaaattactatgtgttgaagttgttaatgcgaatattgaaaaggatgcaattattaagcctagtagtttagattttactttgttcattataagtcacgcatttaattaataaaattataacaaaattttagttttttaaatacatttatttattaaatgaaaaaaaatttaaaaaaataaaaaatcaaatatttttaaaaaaaattagcagaaagaattcagacaattagtttcttatctatgattttgattacaccacttttgttaattttttctagtatgttcactttaaaaaaattggacaaataatttacctcatataaaaacttgggcttttatatgataagcaactttgaagtctttcattgttataccaattaataaatgaacttattttttgataagtaatagttatattttcaaaattttgatgttcaacattgattaattctagctgcaaaatgctatgagaatttaataggattgtttaaaaattatactaattaaaattgaaaaatatttagttatttgttatataattgtataattgtataattatataattaaacaattaaaactctcacaaaataggaaaaataatgtacagaaaaaaagcaaaagccaaaccaatatttttacttggggttggtattttttcacttgttgttgcctcttgttcaacttcaaactcaaatccatttcaaaattatgtcgatccaaatcaaagtcttccaaaaaatcagatagataatttttttcttcagtatcctaattttcctgaagctattaaaaataaaataaaagattccttaaatatttcctcacaaaatttttcaaattcagaatatttgcccaaactttctcaatttgtagaacaatactcatcaacattagttttgtttcaaaaattcgagtctaattttaaatctaaggcaattgataagtcttttagtgttaacgaggagaaatacaataatttaaaaggtgaaattgaatcgtttaatcaaaaaattctaaattcaactaattttgaaactaaattggatgagtttttaaccaaaataagccaattaagcgcggaaattactaaaaccaataacacccttagtcaggaattttcaacttttagctgatttaagacggttttaaaacatgcaaaccttgttaatcttaaagccttaagtgcgcaaattaataacaaaattaccactttatataaaaatgataataaagaagaaattcaaaatttcacctcaaatttactcatattggaaaatattattgcgcaaattaaatcaataaaaaatgaatattcaactgagagcaatgaaattttcaataatttaatcacaaattttaattcaaatataaattctagtagcttaattaacaatgtcactgattcaattagaaactttaaaaatatccaaaataatttagaaaaaattgttaataagtcagcacagaaaaaccaaaaactacaagaattaaagaaatctgctattttagatgttgagaaagccgctaatttatcccaaacagttcaaagtaattttaaagaaaaaataaataactcaattgctgaatcacaaattagtcaaattaaaacatttatttcagaattagaacatgttgcaccgcttctatcttcattgaaaacagaaaaaacaaggctagaaaatgagcctaattatttaaattctgaaaataaaacagaattagatgatctaatgaattccttaaatttattagatcaagaaaataaacttgcattaaatgatgaaatttccactaatacaaaatattttttatctaatgttttaacagtcaatgaaaatgtacagtcagaattagcacgtcttaatggtgatgctcaattaaaagaagctaaaaaaagcttggaaaatcaattattatcgaacaaatttagcccaaattttatttctaatattaaaacactggcagattcaaaaaaattagtttctgatattaagcatataagctccaatattttaaaattagcagattctcttgatttgtatagtgttgaattgaaaaattttcaatctttgttaaacaactcaagtacatctataacaaacaagcaagaacttgaagaaaaaaataacaaaattaaacaaaaattagaccaagatcaccgactcaatggacttgataatgaaaatttggccacatttgttgatcaatttgctaatttagtcacttcattttctcaaacaattttagattcaaaaacgcaaaattaccaaattttgcaagaaaaaacaccagcaaaaattgtagaaaattcatcagattttaaacaacaagcccaaaatgccctaaaaattagtcttgatgaccaaggactagacaatcatagtataaaaaaatatcttacttctgcttcttttaaccttcaaaatgcaaatctttgattaaaaaaaccacaaaataatgaaataaatttcaaattattagacttatcactagatactaacaacagaaatattttagtccttaaatatcaggcgacttcaataaaaaaccctttacattcaacaattttatccacccaacttttaattcctaatgataatgttgacataaatgcgataatctcttcattaaaaatagatcttcttgatgactattttgatattaagtatacttctttccttgattttgaaaaagaagggtttctcaagcaagaagtaaaaaaatttattttagaaaatttttcccaaacaaaacaaacaatcgaaaaatttttccatgttgtattaccagagcaacctgaattaacctttaccagtgataataaaatatctttaaatttagatattaaatttaataaccaagttattaaaacagtcagtgctaaatccaagaatcaagttaattttaaacaaaaagataacttgccagtaaaaattggatatactcaaaactttaaaaacaccagtttttataatcaaacttaccttagcgattctgaatatattgattatgattatacaaggtcagatgattcatcatcttatttttggggaatcgaagagccttatggggctggcggacttggaagttattgattttataaatatttattaaaaccaactttagaaacattgcaacaagccggggagattcctaaaaataaaaaatttaaaacttttgaaaaacacccaaaagttgtaaaagtttcagaaattggtttagaaaagccaacacaacaagatgaattaagtaaggctgagcttgataaaatttttgataaaattttaaaagatcaacatttttttacttacgaaattcctgaaaatgccacaatttcgttttcaacatttgatgttggcaaagaaaaaagaagagttttaacctcaagtattacccaaagtatttccctaaaattattaataaaaaatgacaaacacactagagaagaaattctagaatttgcgcctaaaaattacttaaaaccaactttatcaccgcgtgataaagctgatttatcgttaattgaagaaattttaagcgattctagtggtaaaaaattatttaaaaacacaataattaacgatattgattacacccacggtcaaatttcgctagccggaaaaacgaatttagaaataatagactcacttaacaagctttatacatttggtaaaattggaaaatttgaaatttttgcaaaagaagttatttctacagacattttaaaaggtgaggcaaaaattttcttttgatataaatttaacggcttagaatttccgctattttttaaaggaactaaacctattagaactatcaaaactgaaaaagccattagtttttcaaattgattgccacctacttatagtgatattaaacctaaaaatggttctaatttcaccagtgaggattttttaccaattccagaagaaacaggtcaaataccaataaggagccaaaccttaaaatctaatcagattcccaatgatcacaaatcaataattgataatattaatagtcgccactttgattatcgtagagtaagcgctgaattttataaaaaagcgcaaaaacacataaaatatagactaattgaccctgctgatattgttgaacaaaaagcggaatcaaagttaaattatctacttcaaattagaactaacaatgacagtgttaaaaataaagatttagataagtttaaaaatgaagaagtcaaacttgaagatgaaaacaaaaaaactgaacaaaatagtgaaaatttaccaataattgtcgaaaagcaaatattttttaataccgatcctgaagttagacttgatacttcaaaaattttaaagaattattttgtctattattatgatgttaaaaccactgacaaaccaggggaaatgacttttaaacttggttttattaacaaaaataacacaaagatccgctatagttctaataaagtcataaaattacaaaacttagaaaacgattataaaaataaactttatcctgaaataattctaaatagaatcaaatattctgattttgttcccaaaaataatagatcacttataacaaaggtgttaaataacagcgattttcaaaatttctttgaaatcaaagaacaagctcttaagtataataattttaaaatctcaaggcaaaatttgcaatttcttgagacaaaaaaacataataataaattatatttccgtctaaaatatgttaatggaccacatattgttgaaggatcgacttgatattttctaacaaatataaataaccaaaataatcaagccaatatagatttggacacacaaaagccattagttactttatttgactctgaaaaagaagtaactagaagtcgtgaaattgaaccttattataaagatttattctgaaattacaataattctacaaaaacagctaaatgaatattaaaagaaaaatatttttctcaaacatttttaaagaataatcctaaaaaccggaaaataaaactacaattatttgcaaatgctttagttcaaaacacccaaagacttacccgaattagtggcggagttgacttaatcaaaaacaaaccaattaaaggcggttatgactttatttttgactttgaaaaattagtaaaaggccaaacaatagcaattactgaaaaaaccaaaaatgtattttttgaagatgcaaggaaaaaatttgaggactttagctttactttaagtgctcaatataacaaaaatcaagggattgaatttaaactatgactaaataatccaaatcttggtttaatagtcgataatgttttcaatcatgttgaaaaaggtcttgccttttataatagcccaaaatttgacacttttgatccaaaaaaagcctttattttacataatgccggagcaagagttcatattgaatacacaaactcgcttgaaaatgaagattttggttctaaaacaaatcaatttgattataaaaatattgactacactaatgaagagcagccaatttcattttttaccagttcagatgtttacaatttagaaaaatataatccaaaccaaaatgttccttataaattacatgaaggatatttacaagatttagactttttacatacatcttgggatactaacaaattcccactggcaaaaaatttattagctagaacctttggcttttcttttggaagcgcaactatgcttgcaaaagtaaatgatgatccaaatgatggtaaattttacataatcacaaataatcatgtcgaaggtggtggaaattttgatttaaattctctttttggtaaagatttaactaaatttttattaaatactcgttacatggctattggaagtaaatattattctaattcaattcaaggcggttatagctattgaggtggacaaaatagtgtcaaaaaagttcctacttgattagtttgaaccggtactaagcagccggatgtaaatcaaaaaaatccaaaatttgttgacatatctgttttaatagttgatattaaacctttaattcaagcagcttatgaaagtggtgagttcaaaaaagcagcctgattattaaattgatataaattacctaacttaaaattaaattcaaatggtcaatcggatttaacattttttggtcaaaatgttaaacattttggaatgaatggatttccttatgcaaaacaaagtggttatataataaatagggctaattcagatcaacaaactgtttatattttaaatcaaaaaggttatactccaacatattttaatgctggtaattccggaactggagtattagggctaaatgatgagtatatatcaacgattaattcaggttcgccgcttacatctttacaaagttggaattattcaacagcaagtcataattattttggaataaattgacaaaatgaaaaacctcttgaactaaaaaataaatttagtttatcatcgatgataatgagacttaatgctcaaaatccgcgtgaatataatcttccctggtttttcaaggattttgaaaaataaaataattttaaagtctaaaaaattagtttattaatttagtctatttatttaaatttttctatttttgctgattttattgccattaaaactaaaaaattcaaaaattaatttagtctagaaagtcataaaaatttgaaaaaaaatactaaaaaaagagtaaaatttacttttaaaagataaaattaagtaaattttacttcccaaattaaaaatatctgtgtgttgcttttatattttgaatttgggaatatataattaataaatgtataattgtatatttttttattgatttttcaaagaaaaaaattattctgctttttttgaattatttaaaatagtttttcgagcattttcaggtaaagatttgccatattcaaaataatgaccaatttctttaaatgcgtttttacttatttttaattttgcaaaatcttccggctcaagacttaattttattggctgatttttctcaattttttcaacaaaatcaggatcaggcacaaaggctgaagaaattccgataaaatcagcaaattgaatagctttaactgatttttctaaggaatttattgaaccactagcaataacagggatttttccttgcaatttttcataaactacatcagaaattaaacggttaaaattatttgattttgaccgaactttgtcacgaaaaacgtcaaaacctcaaccggcaattgcaaggtaagaaatttttatcccccttttttcaattaaatctaagaaatctaggaaattttcgactgtataacctaaattatcgcctcttcgttcctcaggtgttgcccggtaacctagcaaaaaattaggattttttgattttaaaatagttttttgtactttttctaatatttctagcaaaaaccgagatctattttcaatattttgacagccatatttatcatttctcttgttagtataatttgagaaaaattcttgaggtaataatttttgggccgaagaaatttcaactccatcaaaacctgccttaattgcccttagacaagcatctgcatattgtctaacaatggttttaatttgcttttgtctaagacgataaaccttgtattttacaggataatttcgcttttcagcactaggtccatagcaaaaaccatctttttcaatttttgaaacagagtgagaaccagcatgaattaattgcaaaattgcgatacttccttttgattttattgcctttgcaagttttgctagaccttcaatatcgcaatcattttcgatactatgaccatatttgaacaaactacctgatttacaaatataaactccccctgtaattgtcattggtgcactatgggctctagcgctaaaaaaatctaaatctgcttggcaaacttggcccatttcagaaagattaagattaattgggctaaaaacaaatcggttttttaatgtgaaattaccaatttgatacggtttaaaaagtttatttttcatatttagtttaaaagtaagttacaaatttcttcttcatcaattttttgactaaaataatcttccaattttgcatcttttagccgatttaatagttgatcttgagttaattttgtccccattaagaaattttctaactctaaaagcgactttttcgggaaaaaatcacctgaaattttaattttactaatttttccttcattaatttctaaagaaaatgttattgttccaacttttgttctaattgatctattgaaggaataatttgggctaagtcctcaaacaaaatcccaatttttgtatttttcagcgaccattttgtcaatttggactcaatcgctatcagtaagctcgtattttttaaacttttctactgaatttactttcaaaaattcggtcaaaaataggtcttttatttcaaaaattgaaaaattttgatattcttttgaaagcttattttttaaattagttacccgttgagaaacagattttatcccttttgcttcaatttttttctggtttggagttagaattttgccaataaaatcaaaatctacatcatataaaagtgaaaaacctgcataaattctatcatttacaagcgacattgccgcaccagaaactttttttccttcaatttgaaggtcattttttccactaaattgcacattttttatccctatgttttgcaaaactttaataacaggatcgtaaaattgtgcataatttccgagtaaatttttatttttttcatatggaaatgaaaaacaaaaatttactccatttctatctaaataaattgcaccaccaccagtgtcgcgtctaacaacttcaatatttttttgctttaaaagttcaaggttaacttcaacacttggattttggaaataaccaatttgtacatgtggatcacaaatataaggaaaaacaattgtttcatctagttttaagtttttgattgctcaatattgaattgcaagcaaaattgctccgtcaaaaactcattttccattgcgttttggttcgattaagtacatttttattcctgttctgttattttttgtagaagtaatttaatatcctcatgaaaaaaataggatttttcaagaatatccttgttagtacggtattttttctgatttataactagatattttgcatttttgaatttttttgtcatctcttgaaatggcaatttaattaattgcggggttgtaaaaccgacccctatttcaagaaaaactaattttttatctttattttgttcaataaaattattgtaatttgctttttggttattgaagttttgatcttcaaccattcctttaaacgaaattcttttgtttatttctaaaaaggcattacattttgggcattttggcaataaattataatcaaccttcatatttttttgattttctaccatttttagaattaattcatcatcttggtataaaaaatttttacacatttttgagcactgcattaaattatatttgccctggatgtaaaaaattttttcattgtcaaatcctgatttttcgaaaaaactatcagaatttgtggttattataaaaaaatttttattttctaaaatttttcttaaattcaaaaaactttctgattctttaagatctaaaaaattaactttcgcaaatctactatgaaaagctcagtatgtttctcatgatccaaaatcataaagcgaagcttgaagcatatctaaaaaatgatatttttcgataaaatctttaaaattatcactaaattttgatccataataattatttccatctgcacttgttagtcctgaaccaactccaacaacaattgcatcagctgaatcaaggattttcttgatttttatcgcttgatctagaatactaaaagtcctcaagttcatcaaattcactttggtctatatcttttgctttaaaaagtcaatttttgtctgaatcatgtgaattcaaaatttttggatccttttcagctaattgatttagttcaataattctacattttaagggtgtttttattgaaaaaacagtttttgacgcttcaattttagcgacaacatcatctttttctagtcgttttttattggtaaattttaaaaatccgattgttccaagatcatcttgtaattcggccgttaaataaatagtaaaaatttcatttttttgttcaattatcaagaaattagcaatttttttcatagcaatcctcttaaattttttgttaatatctaaaatgatgttaccacaaaaaagcaactaatggcaaaaaatctataaattataaatatagataaatcagttaaaaaattcgataaattagtacattaatttcaaaaaaatcaaaaatacagtgtcaaattgaaagaatggaaaatcacatttaaaaacaaaatatttaatattcccgacttttttacaaaattataaaaaattattgtagataaaattaaaaatcagcatgctctaattaaataattatttacttgcttagcaaattatagattttaattaaaaaattaatttggaatacagaaatattttgcaaaaatggtataatggtaaaaaaacattattgacaattatcattattatttttcagaaaagtacaattatgattatttccaagttaaaaaaaattttaggcttcacacttattggccttattcctgtaacatttttttcctatagtagcgtccataacaacataaatttaacaaacgaaaactcacaacctcaattattttcatattatcattataaaccagacaaagcatgaagagcaggaaaagcatggggtattttacaagaacttcgctgatcaaatcacaagggactatctaaaaacactgattactttaatccagaagatcttgattttgaagataatcacaaaatcttaataaccgatcaaggagaattagaaattcttattagaggtgttaaacaagttgtatattggggcggattattttggcaagataaagctgcgtgaataggaagaacggaaattcagtacaccaaaaacagaaatttttccaattattataattataatccagatcaaattaatttaaagacgcatgcttgaatttctggactagctaccccgtcttttgtaataaatggtaaggtagcttatgctactgaaaaaagggaagtaactgctgaaattggtgcatcagcaaaatttgaatttaattcctatgaattaatagaaacttttgaaaaaagaaatgctaatagactagtaatgaattatcaaggggttggatggaattacaaaatatcagattttggtcaatatgcaaccggattagtgatagatgactatgaatatacttcaatcgcaacaaataacccgctaattcccgacaaaaattcaaattatagacccaccatatacccatattatatggacaaaagcaaattttaataatgataaaaatagaaaaattaactaaaaaaattggtaataaatttatttttgataatttaaatctggaaattcctttaaataaaattacatttgtaattggaagatctggaattggtaaatccacactaattaatttgattgccggatttacaaaaaaagacagtggaaaaatttctttttttgacaaaaatggttctgaattggaaaaaccattagttgatgttgtttttcaagactttaatttaattgactcattaagtataaaaaataatattttaatagcaaatcacattttgaatcgtgaatcagatgatttagaaatacaacaagccgctaattctattggtattgaaaccaacaaattagatcagatagcgaaaaacttatcgggcggcgaaaaacagcgagctgcatttttaagaagtttatcaagaaaaagtgattttattttgcttgacgagccaactggtaatttggaccatgaaaattccattgctttactcgatttattagttaaagcttctgaaagtaaaacaattttaattgttagtcatgatttagaattagcaaaccaatatgctgatcaaattattaatttagaaaatttatccgttaatgttatagaaaacaataaacaaattaatgttgaatcaaaaaataaacacttaaacctaatatcaaaccaggtctataaaaaacctggtttcttacaaaaatttaaagtagctttattgcttgtgctcgccgattttaaatcaaaaatcacgagttttattttagttttagtaacattttttgccttaatttttagcatagttgttttcatgaacttacatttttcagcaaaaaatatagtcactgacacgcttgcccaatcaaattttgacgccattagaattggagaaaaggatattatttctttagtccctgaagaaatcgaccaacttaaaaaggataatcccaaaataaaacacactagtttattatatagtagacttcaagattatacattcatttataatgataacgtttctcttgagaatcgttctattagatcaactgatgaatccgatttttttaaaaacagatttagttcatttagtaaaaataaaaattttaataacaggtttattaccaatccaaatgaagttattctctcacaaaaattaattgaagaattagaaattgataatccaattggaaaaacaattaaaattgttcaccttaatcgattaactttagggaaaaactttgaagatttagatcccttttctgaatcagcaacaattgtgggaattttggataagtctcttgataatggcaacaatttttcgcttgttcacatagataaactaaaatcagtatatcaaaaatcaaatccaaacgaaaaagaaagtaagtttgatgaatttgagtttttacctgatgattatttttcattagactttttagggtatgtttctagtagaccattaaccgtagaaactgacgagacacttgcaaaacccaataaaatacataagtctttctatgagaattcaaatcaagccaattcaataaacttgaaaaaaggtacattgcctaaaaattttaatgaaatagcagttagctcgaatataactgacaaaacaggaaaacttttaaaaatttctaacaataaaaatactttaatttttaaagttgttggagtttttgatcctgaaaaagatgacgaaaatattgctatttttaacaataatattgaaaaatattctagtgaattacttccaatagctgctgtggtttattttgatcatgataatttatataataatattaatgaatttttaaataaatatagcaaaccgggcgttagtcgttattactcgacaaatggcggtccggatcaaattctaaatcgagcaattaactctcaatatgttttgttattaattatttttgtgtcaataataatttttggaataagtttgttaatttttgtgtcattatatgcaacaaatctttctaaattcaagaaaaaatcaattggtattctaaagtctcttggtggcaaaacatcacaaattttcttgtatcattgattaaatttggtaatactttctgcttttgttttcgtttttggtattatattttcaatttcttttgtgcccttaatttatggtgcaatttcaaatcaaaattcagtttttcctgattatctgcaaattagtgttatttttataattatctggtttgctagtttctttattttatcaatcatatattcattaatttcttatataacttataaaaaagatattgtgacattattaaaataatttttaaaaattattaaaactaatattttttttatcaaaagtcttaattttataatgttaaataagaaaaatacagcgaacttggagcaaaatgataaaaattgagaatttaactaaaaagattgataacaaaatcatctttgatagtctaaatcttgaaataccttcaagaaaaataacatttataattggtaaatcaggaattggtaaaacaactcttattaacttaattgccggttttactaaaaaagatagtggaaaaattacttttttcgataaaaatggttctgaaattaaaaaaccattagttgatgttgtttttcaagactttaatctaattcctaagatttcatcagaaaataatattttaatcgcaaataatgtaataaatagagttttagatccaaaagaattggaacaacaggctaaatacgtgtcaattgaaactcggcaattaaagcaaaatgtaaataatttatcaggtggcgaaaaacaaagaatagcaattctccgttcgctttcaagagatagtgattttattttactcgatgaaccaactggaaatttggattttgaaaacggtatttctgtatttgaaaatctaaaaaatattgcaaaaaataaaacaatattagtagtcagtcacaatttagaatttgcaaaaaaatatgccgacaaaatcattcgtattgaaaaaggaaaaatttccgaagaaaatattgacaaaactgaggaaaatttagcaaacaacaatgaaaaaaatagtcaattagtttcttttaagagttcttcctattcaaaaattgcaaaaattaggcaagaattaaaaacaggtttattccttactctggcagattataaatcaaaatgagtttcaaccattttatttgtaatactttttctaacaagtatttttgggacattattatttgctgttttaaatttaaatatttccgcttctaattctcttaaagttaatgaatatcaacttgattctgttttagttagcaaaaaatcagaaagaaatttgacaaccttcacagataatgaaattaataatctcagagaaaaaaataaaaccataaaaaaaattactcctttctttactttgccatcattaagttttgaatataatgacaaaagaaggttaggagcacctattgattatattgatgaaagtgaattttttaaaaataggttcaattttgatcaaaaaaatttaattggaagaaacattgaaaaattagatgaagttataatttcaaaagaattagctacacaatttgatatcaaagaaccaaaagaacaagaaattgctgttttaactggccccaaagataaaaaaacattaaaagttgttggaataaataatttagttaatgcaaaaaaattaaacctaacttttttacatcataaattcggtgaaaatatcgaattacagaaaagtaaaaacaggaaaccagacaattcacaagccagtcaaattaaaaaaatagaaccaattattttaaggttgtattttgaaaataataatttggaaaataatattgataattttattaagaataataaagactatcaaattgactcctcattaaaaggtataacaaaattaacttatgatttacaaaattttataaatttaattgttggagcaattttaattgtttttatagtagttttgttaatacaaacgattttttatacaaaaaatctaactgattcaaaagtaaaattaataggaattcttaaggcgcttcgggctaagacatggcagatttttctttatcattgattaaatataattataatttcatttctaattttagtcattaacttatcagtgtctctcccgttaattccaaaaatttacatctgaatactcggtgaagatgccatatatccttcgatttcacagatagtaattttaattttcataatatgaatagcaatgttttttataatttcgtttatttacttattgatttcatggtttaattataaaaaacctgttacaaaattactaaaattcgatcatttttaacgatcatttttttaaaaatatataatttactaacaaatattttttttaaaatatttggtattttatttttttagttttattctgtttagattcccttaatagccggaaaatggtaaaatattaaaaaataaaattaaaaggtctaaaatatgaatcaaaataatcttttagaaaaatacaaacaacaaatcgaggaaatttcctcaaaagagctaaattcagaccaaaaaaatttagcaattcaaattttagaaaaatttgaaccaaataaacttgaatacgtttttcagtttatttctcaacgaatcaaaactggttttcgttttgatgcagctcctgaatctgattcagatttagttgcaattttacaaaaaaatgaaaatttatcttttgttttagacaaaagtcaatctgaagaaaatactttaataattggcgaaaattatgatgctcttaaaaatcttttagttctcgagagagagagagagagagagagcggctggttatgatataatttatattgatccaccttataatactcaggctagttttaatgaaggtaatcaggttgcaaatgataaagaaaatattttaccttcaaaatttatttatcgagataaatactcgcgaaatggctggctaaatttattaaatgaaagactaaatttagccaaaaaacttttaaaagaagatggaataatttttatctcaattgatgataatcagcaagcttatctaaaagttttaatggatgaaattttcggggaagaaaattttgttgctaatattgtgtgagttaaaaaaaatagtccaggtggaaatactagttttgattataaaataacacaaaacacagaatatattattacttatgctaaaaatttaaacaaatgtaagttcaattaccaaaaatatgatgaaaaaactcttaaaaaattaggatatacacttaaagataaatattttgaccaaagaggttattataaattgactgaccttcatcgtacatcatctacaggcgcatttcaatatataaagtctttggattatcctattattgcccctgatggtactagttttactttgtatttaaataagaataatcccgaatcagcttgttatacttgagggaaagatacttttgtcgaaggggaaaaacaaggatttattgaaattgttaaaaattctcgtggcgattgggttgctaaacgtaaacagtatcaatatgttaaatttaatccaaaaactaaaaaaattgaagaaattgtcgctggtgtaccgtttaaaaatattattagtgatttttattcattaaacggtggcctagaactcaaagaaatttttaatagtaaaaatatctttgatttccccaaaccaattgaattaattaagtatttaattaatattcatcccaataaaaatgcaaaaattcttgatttttttgccggtagtggaacaaccggccatgcagtttgagagttgaaccgtcaggatggcggaaacagaatttttactttagtcacaaacaatcaaaataaaattgccgaaaatgtaacttatgaaagactttttagaatttcaaatggaaaaggaaccaaaaatgaagaatttaattgaagtaaaaataacaaaccttacttggaaaatttaaaggtttttgatatagtttattataatactcaaatttttaactcagaaagtgaacttaatgatttggttaatttacttttaaaactttttaaagattttgatattaaagttgacttaaatcatatagatactaaaaataccaggtatgttgaacttttaaatcatcttttagcactaaaaccacaagaaaaggatttataaaattatggaattaacgcaatctcaatctaaagcggttgaacaattagttgaaaaaacaactttatatctgactagtagtgaagaaattgagccaaaattagaaaatgataaaaaccaaacaaatccagcaaaactaaaaaatgcaatttattttaaagcgccgacaggatcgggaaaaactttcatgattctaaactatattgataaattaattgaatgaaataaagcgaaagttggtaaagaattagtttttgtaattgtaacattatcaagtgctgaattacccaagcaaatggaagaaagttttaatgaatataaaatttttataaaaaatacaaatttgaatatagagagaattgaaagtccttcaaacttgaaaagaacggcaaaagttgataaaaactatgaattttttgccaaacctgattcagtttttattatgggtggcgcatcttttaaatcaaattctattttacgtgaacaaggatcaattgaagcatttttgtctgaaattaaacgaaaagggcaaattcttatttatataagagatgaagctcatattggttctgatattaaaattaatttaaaagacaaaacttttgaagaaaaaatgcaagaaaatgcatcatttatattaaaaatgacagcaactccaaaaactgatttgccattagttcatttatctgaaaaagatttaagtcaagatgatattcaacttttaaaaactcaaaaacatcataattttgacttagaaaaaggtgaagattatgatgatgaagaaattttggaaatagcttgtaaaaaatttaacgaaattaaaaaacaatataatgataatattaaagagcctggtttagtcggtattaaccctgcaatgctaattcaaattgataatagtagtgaaaaagatgctcaaaaagcgcaaaaatttgatgaaaatattgaaaaaataattaaaatactcgaaaagcatgatcttagttgggtcaaatattttgaccaaaataaaaaagaaagtaatttgcgccaaaaatctaatttcacattacgtgatatttctagaaatatgtcttcagttgatgtaataatttttaaaattggccctgcaacaggatgaaatattccaagagcatgcatgttagtccaacttagaaatatttcatcttctaatttaagtattcaaacaattggtagaataaaaagaaatccttgccctatgtatactttaaaagataattccattgctcgtaaatattttatttatagtaatgttgaccctgagagaaaaaatgtgcttaaactttatttgaaggaaaaatataaatatgacaaatttatatgaggccaaatccaaattcccggaatgcctgacgaaactagaagtaaaataattaattataaacaatatgaaaacgaatttgaacataaatttaacgataagaggcagaatcaggttaaagaaatttttaaaaacgatttgagaaaatatgaagacgactataaggccaataaatttatttctattgatactgaaaaatatggttcagcaagattaattaaatcaaaaatttccaacattattgaattagaattagcaattattagacttaaaaacaatttaaaaaagtattttacttccaaaattgaagacttttttgctaaaataaaacaagattttttatcagatataaaaacaaataaacaaattttagatttaattattttgttaaaatacgggccagaacttgctaaaatttataaaaaaacaattaaagaccaagtcaaaaacgctcagtataaactttttgaagaatgtttacctaaagaaattgaatttaatagtgctgaaaatgataaattggtgaaaactaatgattcttcttttgcttataaaaaaattgatgacaaaacaccagaagataatcttccattagattcagaagcagaactgttttttgcaaaagaattaataaaaattagtaaagcaaagcaaaatattcatttttgagctaaaaacccagtctatactaaattaggttttcaatacattaacggaaatgaaattgcaaaatcaaatcctgattttttggttagcaaagatggaaattatttttattttgagatcaaacattataaagattttgatcctgaaaaaactcaattattaataaggggatataatcaatatttcaaagaaaatcaaataaatcaaaaaaatttaaccttagctgtttgttgagttgttcctaaatacggagacctttattttgctggatcttctaatttagagcaaattcgagataaaattgattttaataaaaaaacaaatagcgatattaacgatattagcgataaagaatttgaagaaaaaagaaaaaaaattgccccaatgcttttaaccgacattataaattaaataataaataatctttcttaaagatcaaaaaatctatgattcattcataggtaatttagtatattaatttatagtttgttcaatcgtttttattatagataataaaattattaataatgtgtattcttgaaactagtgataaaacagagttttttttgtagttttcaaacaaaaaaacctaaatattttttatttttcaaatattaattaaagccattttcaaatttgaaagtaatttgaaaattgctaaatttatccaaatttgtgtaaaaatttatttttagcttaatttctaaaaaaggataaaaacctgaaattataactaagttactatactaacttagttatttttaaacggtaatttccactttgaatttcgccttttgtttttctattttccctaatcggttaagtaatgtaaaattaaattagatttctatttgaaaaatccataaaaatttaaacccgagtttcccagtttgatgagataattttaaaaaagtgtccggtttcccgcgcttttttaagttttttgccaaaagttaattacctatttttttactgatttattaagatatcaaagtagaaatcatacctatttcaaatattgggatcactaggaacaccatcgcgatttttaaatatcatttgctgatctaaagtgttaaattcaaccctttgccttaatttttgcaacatcgttactaaaccaacttcagttaattgactgtttgcaaataacttgttatcactaatatgcttgttgattttaaaaattatagtttttaaaataactaatgagataaagcacaaaaatgtatgagctaggatatgatcatctattcttaaaaatacaggacgaatattcaataaaccttttagacttctaaaattagcttcaatatttcactgtttttggtatttttcaactatgtctaagacatttaaatttagtatatttgtttcatagacatagtaaccatcaaattgtttgtccttgtcaattttactttgatctaattcaaatttcatatttgaaatttccctaaaatatttaggttttttaccaaacaatttgtttacttcaataaaaccatctttattttgttttttaataaaactttggatttgctcttcgcgagccttgctgtcttttattgctctttttctactgtaagtaataattcttcttctaatattttcagtgtatcttttatttttataagatgaataaaattcttcttttttatacttaaaatctgcatttagatcaacataatcgctaggatctaataaataatttttaaatttttgactgcctatctttgcacgataagaaataatgaaattatattcttttgattcaagaaatcgaatatttgcagcagtggacatgccacggtcagcaattattgtcatatttttgatattatatttagattcaatatctaatacaaaagggattagggtactagaatcggctgtatttcctttaaaaactttaatatgaaaaggaatgccatttttatcgcatgctaaagcaatgacaatttgatcttctttgaatttagcatctttagaatagccaggaattcttaatccatttctttcaaatgtctcaaaatagactgttgatgaatcaaaataaaattcattgtccctttttccaagctcgcttataaccattttgttaagactatctaaaagttgattttgtgattcatagacaagatctaagagtctataaaagctatttttggaagtatttatttgatttgagtaatcatcctttttatcaaaagcattaataatgctaccaggatcagtaattcgctttgaaattaagtagttaaaaatttgtttcatatttttatgcctacttttaggaagtgattcaaaaatattgtgcttttctataagtttttcaattaattccccaccaataaaaaccgaaccttcgattatggcagaatttttaagagaatcaagtaaagtagtcttgattttatctttgtcatctaaatttgaaaataatttcaatttttctttgataatttgaatagcatttggattaattttttccaaagtttgcacatttcctatactaaatcaacgttttggagctttcccataaccttgtgttcagccaacatatttatatattttatcttttgaagatcctcaaacattaaacaaaatcaaattatgctttttcataatttataattataccataaaattactttaaaattgtaattaattgtaattaataaaaattaaggttttacgggtaaaaaacaccgatttacggcgatttctgcatattcatattcactaaaaagtgaattttcgccatcaaactgggaaactcaggattagatttctatttgaaaaatccataaaaatttaaaacacaaaattataaacactcccaatccaaccagttaataagcttaatcaatggttttcctatagttttaataatattttttaaaaaaatttgataaaaaaatagttgaatttagattattaatttgatttatatatgctataattttttaatttaatttaaacctaaaacaatttttcggggacaaaatgcatatagatttacatttaaataccaaaaatgattacaaaaattactcatattatcaaagctctaattactattcaaatggatgaaatagaaaacctagcagaagtgaagtttctgattttataaacgaactaatgaatgaggctaaaaaaagtgcaaaaatatttgataaagaaatgattttttcagtgttaagtgatcttgaatctaaaaatatagaagttggttttaatattaactcacaaaatacaagtgattttaatagagttttttttaattatttagaaaataatcaaggctcaagctttgacaaatatgtgcttgagtctgattgagagaatttatcttactgacttagaacatttgttgagaatgttttaacatacaagtattatttatcgaaaatatcaaatattatttctacagttattgggcttttgagtggaagttggtttatcgataatgctattaattttctttttggtgtagacactagcgatcctatctatgcttttggattatctaaaattttagataaatccgaaatcaaaacgccaatggcaaaaattaaggaagcattaagcaaaagtgggttagacgataaaattgttcaaaaattgtcgtctaagttttcttgggctaaatcaattaatcctgctaaaatcgggaatatgtttctgttgtttacatctattttcacttcagcagaatctagccaatatcaagatagaaatggtaatcttgattattttgtccaaaaagcaagaaaattaatagatgggagacgttctattggtaaattagcgttattattgaaaatgatcgattacaaggtatatgatgttccctgatatcgttttttagaaccaagtgtttgattcttaattagcggaaccagaaaactttcttcattagtagaagaagtctataaacgttctactgataaatatataaaagaactttatcaagaatatttaaatccttcatattattaatgtttaataaaaatggtgtttaatgaatatatctaagcattcaataattttaaataattatgttaaattttcaaactcttattttattaaaaaggggcaaaaagaacagcaaattcttacactttcaataatttcattcgtctttcttatcattttttttattgggtttggcctgctttgagaaaagaatatatgatgattaggtcctgcagtattttggcccttaccctttgtttgactttattttgttttaggtattttgcttagaaaaaaatttgttgagtattttgataataattccattcttaaatctataaaatttttaaaattatttttaataagccgcttgagttttgggcttttgtataaattaagagatgaaaattttgagaaatattataaaaaagccaaagaattagcaaaaattgacccctcaattgttttttatggctcattcgccgaaagtatgacttttttaaaatctcgtgaaattaacgatctagatttttgctcaagttctaatttacgttatgatttagggattaaaaaaacaacaattcttgataataaacaaatcattgacccttatatttataaaaaaaacgatgaatcaacgagaagtgagggacttagttttatttttgtaccaagaaaatatcaaacaaatgttgaaaatttaacaattacttcatcagtttaccaaattgcaaataaaattaatagattagtattacttccaagtatgatgaatttgagtgaaaattataaaattaaattcaaaaatacaatagatgatttaaaagaaatttccaaatttaatttgccttttacaaaagctaaactttgtcaatgttattttgatgcaattttgcaaaaaagccaatatatttgtgttttaaatcaagataaaatattaaataatattcaaaaaattgatttaaatttattcattgaaaatttcactgaaaatgtcgagttaaccttggaaaatccgttcacaaactatggaaaacccttcaaaatttccgttttagaattgataaaagaatttgagaatgacactaaaattaaaaatttacgtcttgcatttgataatgattttcataaattttttaacgatataattttgcctgatcctcattataaatctgatttgccattgctcgaatttagctcaaaacacgagtttaatattttcaaagaaaaactcggaataagcaatttatcattaaattgcttaagcccaaatttagtattttcatataaaaatgatcatagcattgatattaggcatatttttgcaatttttattgctaagaaatttaaggaattagaggaaaatgaaaaataattataaaaaaatttccttatattataaatcaacaactccctttacatacatcatttttcgctgatttattttagcaatagtggtgggattaatagcagcaggaatttatttttgggataattatgaccgtcttccggttccgccatatatttatgtttttattccactttgtattttggtagtgcctttgtttttacagacattaataaattctgtttatttttttgttagcccaaaaattcttggtaaattattagaaaaaaattggtttttatgattaagcacaaaattaatgtcaaaatctcgactaaataaggcagaaattttacgctacgttgactaaaaaaatttttcaataaaaatacttatttactataaaaaaagttatataattatttatgcaaataattatatacgaggtcattaatataaaaatgaaagcattagtttaccgtgccgatcacagcattgccctcgaaaatgttgtcaaaccagttatacaaaaaccaacagatgcaattgttagagttaccaacaactatttgtggtacagacttaggaatttttaaagggaaaaatcctgaagttgcctcaggtagaattttaagtcacgaaggtattcggagtgtttataattttgtgtttttcttaattaatttattcagtgatccaattgaatttattggataaattgattgtcttaattcatatggataatttaaaaaatgtctttgtgaaaatctaaattagtagaaaaaattcagacaattagttttttatctatgattttgattccactgtctttgttaatttttggcattctatttttaaaaaatctaaataaataacttatatcatataaaatttaagctcttatatgaaaagcaatagttacattttcaaaattaatttagatgcaaaattggctcatttttcttgttttttgccccgcagaaacaagttaattattttagattttaactttatattttttagattttttttctagaagtctagaaaagtctataaaaaggttgcttaaaatgcaaatgagtttttaccacaaactacaaataaaaattatttgcctgattttttttactaatttaaacttatatgtagtttttttcttttggatcttcttcatatttatctaaataattgttttttaaatcttcaattagttcaagtcggctaacttttttatcaaaaacgacatttttatccttaggaaaagccaggatttggaaggccactttatcaaaactagattcgggacttctaacaaaatttagtgttaaatccgtttgaaaaattgctgtcaaaaaaatattattattttctgtttttctaagaaccaatttttctcattccgccctttttgaaaaattagtagggggcgatataggctggagaacccctcctcaaaatggttcataaccaattcgctcccaagtttcgtaaataaaaatattattattttttagaaattcatcaagtttttcgctgtttagaaatttttcttcaaaatcagaaattaaatcattttggtcaagttttaatttaggatctaattttaaaattcggtcaataattgttgtcttaaattcgtcaatatttttaataattacatgtttttttggtaaaaaactgttagatcaaggattaattttatttgtaattaaatcaagaatttttggctttaaagttttaatattattaatttcttggctaaaatcgataatattaaacataaaagaggggtaagaagtactaatcttgttttttgataaattgtacttttttgcgagtttattataaatttttctagcttctccttcaattaatattttctttcttttatagtctatatttttatcattatggccagtgtaaattttttcttcaatgttcctaaaggtgattgttttatttttagggtagactataacattaaaaaaaggtgaatctttaaaaactacagcgggctcaattaaatctgcatctataatataatctggtgtaaatcttgtggctataatgtttgaaaaaccattttcttcaaaataatagtgggtaacacgagttggcattcaatagctgccacgctcgcctattataatattgtttttttctaagactttttcaagaagctctccttttagaaatttgtcttcaaattctgacttgagttcagaactattaacattggcaatattaggattattttttataatttcttcagttctatcaacaatatttttttgaaattgctctaaattttcaattgttattctactttgttcaccaaggaataaaaatttgtcccgttgtttttcgggttgattataaaacagatttaaggctgaaaaagtaccattttttgcattaaattcttcataatgcttcgctagtaaatttaaaaaataataagaattataattttctggattgttaattccctcatctttgttaaaaatttgcttaacaataaaaggaattaaatttctgcaggaagttaaaaaaaatgccggaattaaaagggttattcccaaaaatttactaaggattagtttatttttcattattaaccaaataagaaagtgctaatttatcttcaacagaattattaaaagttacagatttaaattttttgatataaagccgatagtagcctgattcttttgctctaaaatcaattaattcatcattgcttttaatacttgttgaccaagaaacatcaattcaattattgtttgaatcaagtttttgcaaatacaaatcataatctgaaacccaagtgtcattttgattttttttagtagcttctaagtttaaacgttcagaattaatatgtgtttttgaccatttgtcaaagtcatttttatatttgtccatcttagcttttttgaattttaatcttgatttttctatttttttaataaattcaagattaaaattacttatttctttagattcagtactcccgaaattagggtttaacaatagttttaattcgaattgattatcaaaatcatcaatttttggcgagttacttaactgtttggcaaaaggttctcttatatcgattttattactaaaatttgaagcatatcaatattttttagtattaaaatttataagaaaagagtgatatattaaaaaaattgatggtcaaaacatcaataataaaattatttttttaaatttcgctaatttcattttcatacccaattaaaattatttataaacattataacatgttttatgtttttaatttaattatattcattttattatcgctttaatttttttattgaaaacccgacttctacttttaaataaatatttatcattatacttttattaacaaattatgactaataatcatgagctttatttattaataatttgcaatattctaaaaaattttaaaattctcacaataaattattggccttttgccacataaaaaaaataaaattaaacgaaatctaaattagtatattaatttcagacacattcgaaaagaaggtgagtcaaaatgaaacaatagaaattcacagttgaagacaaatttaaatatatcaaaattgctgaaaccaaagggttaaaaattgcaattttgcattttgcagaaaaatttagagaaatttacaaaaacaaatctaaaagtaaaaatgcgcataaagaatggattttacatatatatggtaataatttgataagaaattggaaaaaagttttataataatggtatgaaaagtctaataattgctcgtgggaaaaacaaatctcaatgcagaccaaaaaaggaatatacaattaacgatctctctgaaaatgatcgtggaatttatcaagaaataatggagaatgttcttagaagatccggaattgaccccgcaattgttcttgaagagctcaaaaaacgaaaacaagaactagaacaacaacaaaagcaagaacaagaaaaagataaaatggaaaattaagttagtatataagctagttttctgaatttttctactaatttttaggaatttctacttaatactttatataaaatagcgtgtttttaccttcgtttaatagaaaaattcacaatttaaaaatattcaaaaacttaatttcttacatgacctttaattaaataactgattctattaataaaatcatcataatcatttattattactgaattttgaatttgagtttctattggttttagtatatttgaaaattcaaaagcattgaaaggattgtcaaggtgaaaattagcgaccgttttataatcttcaaaattttcaatttcatttatattattgtgttcagaattattttctaaatttaagcaaacaaaattgataattacaattaaaactttattaggtatatgtctaaaatctgattgattttcagttgaaagttttgcatatttaagaaagttcttataatttaatttaattttccccattttttattaattctatttttagaaaaataaggaatctgttcaaaaataattaagatctgaaaatataatttatcattttgactacgaatattggcagtttctccaagcatattttcaaaataatttattgaattttgtaaataattttgcacaacaaacttaagacctataccagcaattatttcgtttttatattcaattccgatatctacttttttatcataataccgaccgatcattttagcttctttttgaaattgatttccgctatcaacacctaatgaatatattttaaaatcttgccctaagttttgcgacattgaactagcaacaaaactatgaattatctttattttttcagttgatcttgacgaacctttatgaagataagttataaaactttctttaattttttcatttacgtccctaacataaagtctaaatattttttaacatcttttgttgaaaaagtataataaccaccatttttgtactttcctaataattctacaaagtcaagaaaaactttactttgtaatctttcagcaattgatttatagtcaattttctcgcttataatgtaaaaaccactataaatacaggtgtttttttggattaaacttatttttaaaggtctgttttccttgactaatgaatttaaaaccagtctttctttatcagtgtctgaaatagcttgtcttcgaccaaaactataccaaaaatttttatttgaatgatcaaagctacgtttttgcagtttttccttaaaaaaactaaggtgttcaaaaatttctaactgctgttttaattcagaatctgaaataatttggaaatttttagtattatacggaaaaatgatttttgcccattttccatttgatgcttttaaaacgggcaaaatatatttagaattaaatttaaaatcgccaataaaaactgaatcagccaaggttgccaaaccatttttgacactaatatcactttttttcttgttgtaaataatttcctttagaaaagatagcttttctggagttgaaaaataaaaattcttatctaaataaaattgttcatattctaatttagaaacaagaaaaattgaatttgttttattatcaaaattaaaataatcgaccacttgttttctagctgatttatcaattgtgaaaatcgttgtataagttgttgctttaaaaaattggtgatgtttatgatcaacaactgattttatgattttatttttgtataaaaattcccgaaaaattgagcctgctttggatgtaaaaaatgaagatggactaatataagataaaattccatttttacttaacattttaataccaatttcataaaaagcaaggtaaatatctgtcataccaattgttggaaaattaaaatttttcaacaatttattattatttaaattatgaatgcgaatataaggtggatttccgacaacaaaatccatttttccgttaaaatgttcaatttcaagggtatttttagctttaaaatctcagtttactccttcaattttataattttgaacaactaaatttgcacggaaaatggcattttttatatgtttttcttcaatatcaatgccatgaatataagtttctaattgatgtttaagcgattttaaattcgaattttctctaaaaaaagctttgcaataacgttcaataattttaactaaaaattgaccattaccacaactgttatcaataatatgttttttaagtatgttttctttgtaaccagcttgatctaaaataaggtcaaccaataaatctggtgtaaaaacttgcccatttaatttttgactaacattctcatgcataaataaacttttatttcttattttattttaaattacgaagttaatataaaattataccaaaaattagcaaaagttatgcattcaaaatcattgataaaaactaattgtctgaatttttttctactaatttaaagttaaaattagaacattcttaaaactttacaaaaattaaattttaaatacaaaaaatttaattaggcgttctggagtaagccgcactataaaaatagcgaacaaaattataccagtatagttgatgattaagcgagaatcatcaagtagtgtaaaagaataacttaatattcaaaacgagtatcaaaacgtaataaaatttataaaagctgaaaataaataaataattaagaaacgaacttgccgttttttaataataggatttaaatcagcgctttttgtattaaatgagaagacatgtaaaaatatatctaaataataggaaggcaaatatacttttgtagttaattccaaaccttcaatcataacaaaaatattttcaatgattttatcagggttatatctatcttttttgcgtacgttgattcaaatataaacgtttttttcctttataagattataatttttttcaaaatcaaaattagctaagaaatcaaattgcttatttatatctaatttacctaatttttttttacatttctttattaggtaaaaattaaaaattttttggaaaaaactacacaaatatgaataaggcaacaacaggagcgagtaaaaaattgcttcgataaaatgtcgaaaaaagtaattatcaaaaatttttgcattaaaatgaattaaaaaatcaaatttaagcgtaaaaattagtattaaaataattaaaaaaaatggtagtggataacttattaaaaacagtgtgaatagcaaaacaaagtgtttgattgtttttttatcaggattaaatttgaatacaagaaaggagaacaacctaaaatacaaaatattacctaaaataggaacttttgaaaattctctaggaattttcaaattaataaatttttcaacagttaatcagaaatacatttttacaaaacaaatttccttgaattaaattaataaactggttaaacaagtctaagaatcaaacattttgtctttaataatactatcaaaaaaatcaaaaatttattcttcaaatagtcaaaaagttattcataatttaggataataagccacccagggtatcgtgatataaccaaaaaatatagtagaaaaactagagagtaataattgtattgtttcgttattagtatcatttaaattgccatctacttcagatatatgttccattataaaataagatattattcaaaacggatatcaagttagtataagatgtataaaaacaaaagcaaaataaatgtataaaaagattttccagttttttttaggaatatttgaatttgtaaattcagtagtgttaaacaaaaaaacttccaaaattatatgtgcaaaatattttggcaaatttcaattaattactcaccatcaatattggatatagataaaaatattttcaattattttttctggattataccaatgttttttttcaataccaatataaaattttcgttgacatagaaattcataatatttagtataattaaaattgtttaaaaatgggaatttattatttgcgtccaacttgccaagattttttttaacttgttttaccaagtataaatgaaaaattttttgaagaaaacctgaaaaataagaataaggcagaattaaaaacgagtagccaattacttcgatcaaatgccgaataaaataattattaaaaaattttaaatctaaattccttagaaaatcagcattatcggtaattaacaatattattataattaaaaaaagaggagtcggataacttattaaagaaagtactacaaataaaaagtaattttttattgtttttttatcaggattaaatttaaaaactaaaaatgaaaatagtttaaaatacaaagtattacttaaaataggaatttttaaaaattttttcggtatttgaaggtttataaatttttcaactgttaatcaaaaattcattttaaggtataaactccataattaaggaaacaaaagactgcaaaacatcaagccaaatcaaggcaattctaacttgcggcgcaactaaacttgcagtgattaatgtcgcttttgttgtagattgcgcactttttattttttttattgctgatcgtgcatttaatattgttttcaacgatagccccatagacccgattttaaggcctgttacatacaactttgttttaatagcggatcaatttttatcatatacaagactattataagcctgtttatattcaacagaaagtcaggttaagacacttccagctgctgtgctagcgccggcttggggaaacataaaagcaaagccataggcaaccgctaggccaaaatttatagcagcaaatgaggcgctagtaacatgttctttccataatttatttgcaaaatcttctatcgtcatagaattgggcgaattatttgaaaatgtttgcggttttagatttgttattttattagcgttaggttgggaattagaaggttgataatcaaatatttctttaattttattggaaggcacccctttcttttccaacatttctttggcaagtttttttgcatctaaatctggattttgcgaaattttgtcgataaactgttgaaaatccttctcaaattttgagaaatccttaatatagggcttagaatttgggtcagttgatgagaaggatttaacattaatttgccttagctcggtaattacctttgaagattctgattttagtgtgtccttaaaataggaaggaaatatactttggtcatcattaattgctttttgtgatttgcttaaaaatacaaaaggcaaagaaactgctactgatccgatagttacaccaaataaaattgatagttttgcaaatttggtcatttttttttttttttttttttttttttttttttttttttgcctttttaagcactattataagtataaataatataataaattctgttaagttagtatatcaatttaggttttttaattaataggaaaaattcagataattagtttttatctattattttaattataccacttttgataattttttctagcatattcattttaaaaaatctaaagaaataatttgcctaatataaaaacttgaatttttatatgatggacaactctttcaagttttgaatagttatacaaatcaataaatgaacttattttttgataagtaataggtacattttcaaaatttttacttcaatattgattaatttttgctcccaaaaggcaaaaaaattcaatagaaataattaggattagccctatctttctaagaaaattttccatttttcctgataaattcggctatcattttttagaaacagtcttaattttctatttcttttttgggttaacgggatttatttttcatagacttatcaaacttttttgccaatttattattaaattgtttcattttgacacctttttttaatgtgtctgaaattagtatactaatttagtttttattttgaaaaactttcaaattttactcagttgcttgaaaagtatcgttattttgctcaatatgtcttgaattaaaaacaattttttctgaaccatcatcttttcagaaaataaatgtgtaaaatttgcctttttctagtttctgatcttgctcatctcatctaaaaactaagggaaactcaatattttcaccttcaattgcggttgtacgagcgaccttaacttttaaaggatcaactagagtgttgtcagttaatgattttacctcagtagcataagcgcttcattttcctgtaacaccttttaccggtgagtgatgcaattgaaaacggaaaacaccttgactatctagtttattttcatttcttgcagctggaaataataaagttcgaattttgacattatctttttttggaatattaaatggagcagaatgaaagtcgattgtttggttagtttttttagtttttgttgcctcttgattgcccatttttatggctttatttttatcttcttgactagtttgggcatcttttttggtagtttcaggagctgtttgacttttatcgtggcatgataaaacaataaaaataggcagtacagaagctattggaacaagccttaatttaacaattttttttatatttttgaacatttttctccttttttgctcagttttttattttttttgctttgaaaaacaaagaatttaaataaaccaataagattttatagcccctaaatttaaaattactaaattataccattaattttgaatttattaatgcttaactctaaaaaattttataattttggattttaagaatttatatggtatatttttattataaaatcaaaggaaaaaatagcaataattactagtaaattagtgaaaaaaaattgataaaaatggtaaaatcaaaattatagataaaaagctagctgtctaaattttttcaactaaattagccactttttagctatttttattggaaaataactaaaaactggattaaaaaagagtatttttataataattccttttaaaattgaaccaaggagtaaaaatgaaaataataaatgattattttaaatttgaagactataaaaacaaggcaaaagcggaatttcaccctaaattagatgaaattatcaagaaaaaacattcaaagtctcttgaaaaagttgctggattacaaaatgaggcaaaaaaacttaatattacctcgtcaatttcattctttttaactatgattgttattcttgttgctaccaatacccaactaggatatactagcatcatttttgccattattcccggaataattgcaattgtttctactttttacttaggattcaaaaaaaaggaaattagaaaaatcaccgatgaaatttcaaaagacgtcctagttaattttagaccagaagttgcttataaagctgccttttcaattttagataaaggaatggattatttaggttttaatgaccaacctagcaacaaaattcaaatttcaaaaaacgaaattactaaccttactcccgtagaaataattggctcatcaagggcttgaattagtcaagttagacctctgaaggaattattaattgatgaaaaattccatgttagctttacaaatgtccactgacaatgaaaagaaacaagaaaaaatgaaactgtgacaagagaaagttttactggaattttaaaaattgatacttcaattttaggtgaaaaggcatttgattttaaacttttaaaaccaggcagctgattttttcaaaaaaacaaagtcaaacttgaaaacgaggaatttaaccaggtttttagtccagaatcaaatgatagattgaaaatcagaaaaatgtatacaccccttgcaatggaactttcgctaaaaagatattttgaccgtgatggcgttaaagttttggatgttagcattgaatcttttcaaaatgcgatctattttacctacaaatgcgactgaaattttatgtatcttgattttccaacatcaataaaaagccctgatgactttattaatcatattttcaacgattttttgattgacacttacagtttgtattatcttttgtgtcttatttacgttactttgtatttggattagttaaaaacataatattttcaaaaaaaatatggtataatttttaatttaattaatatttaaaggaaaaaaatgtcaaatttatacaaccctaaaaattctgcaaatatcgaaggatttgaacctcgaattgataatgactccaaaaaaccggttgtttcaacagcggctaaagttgcattttgaactttggggacattgtttttatttattgctccaatttattacatttcacaaaaaaataattttatgcgacagcagaatttaatcaatgaatcagctggtacaatcgaagttcaacttgagcaacgtagcgcaactttattaaaattagctgaccaagttcgttcatatcgtgaatatgaaaaatcaattttaagcgacattacaagattaagaagtttaaagtcaaacatagaaaatgctcaagaaattgaagatttaaacaattcattatttggcagactaattgcagtaagtgaaaattacccagaattgcaagcatcaaaaatttatcaagaattaatccaacaaacagcctatttagaaagagaattggcggctgcaagacgactttataatagcaatgttaattcttttaatacccaaatttttatctttccttcttcaattgttgcatcttcgatgaatttgacaacctacccaatgtttagcacaagcaaccaaaatcgccaagatgtatcattcaaagatttttaatttcttatattaaaaacagacataatttctcaataaatttgcaatttaaacaataaaaattttaggaatcaaggactaaaatcccacaacaataattaattttagatacttattgttatatttttatactaaatacacaaaaaataatcctaaaacagtataaaatttaaaaaacacacctttagacaaataatatcgcttttaaatccaagaaatatttgcttaaattaattcttcaggtttcgtgagatttatttgccttatttttatattaatttaagttagattagctcgttaattttctattagtcaaactaataataaaatgtattttaaaaatctaaaaaaactcttactttataagaaaaaaacaaaaaaaccgtgaaattaaattagtagaaaaaattcagacaattagttttttatctatgattttaattataccacttttattaattttttctactaatttaaatgtttggccttgctttgttagagaagtgtgatttctaattttttaaaactattaatgtgacttatgcattttttggtgtgaaattgtctaatgattctcttttgtcgatgtaggcaaaaaataaaaacattaccattgaaaatacatcaaacaatggtatgaaaaagccaataattgctgtaattttaattattgaaagttttagtgattttgatgaatttggttctatattcataaaaattttgtcagggaaacttacttttacgatataactaatcgttaaaactcggcttacaatagtaacaaaaattcaaataaacatagttgctataagttcagaaccaacaataaatgagtcgcgatttgaaaatcatgtgataatgaaagggataacaaataagaaaaataaactagtgcctaatataaatttaagaagacgcactactagtgataaaaaagttagatttttaacattggccactggttttattgttttactaattttcataatataataaattatactttattcttgtttaaaagttagaaaattatttttaaatatttaaattcctgttgttctgtaatttagactttaaaaatattgtaaattttgaggtgcaaatgtttgttgctccaaataaaatttgaataaaaattcaaaaaattgaactttttaaattttttgatataaaagttcatatttttactagattttcctttattttataagtaatgttataattaattatgtaattcataaaatatttagttattaggattttttatgacatgagcaaaaaaatatagatagtaatttgcttaaagatctaaaagaaactctaaatatagaatttgttgatttaaaaatattagataaaaatattaatttaattagtaagtcaactagtggtaacaaaaatcttgaaattactgaatttaaaattccaagcatttcgttatgattctaatgaaaataatcttcctgagctggttataacttatgtcaaaaaatagtaaaagaaatttttgaacttttttctcccttggaacctggttttgaattcaaagctcaattttagttgctatcggtgggtatttaatttatgtttatgattatcaaaatcaacagcagctgtcaaaaataagtgaatatcgattttgaaatgataaaaagaatgtcttaacatttgaaggtgaatatcctcgtttttttatagataacatccataaattaactgatgaagaattaaaaacaaaaacaggctctaaaaaatcattgaatatccatgattttagagatgagtatgtatttattagaaaaaatcagttttcgtttaaaaaggaaaaacaggaaagtgaaaataataagcaattatataatactcatttaattaaaaatacgcaagatcttgttgacttaattatacctaataagcaaaaattatcctcactaactaatagacctggtacgggatttcctgatgaaaaagagattaatgaactaagtgaaacaattgatttatcaaataaagatgcaatcattttgaataattatgttagtcaactttttggttcttgaggtgatcgaagagcaaaagggctaaatcttattgattttagttttaatgaaaatacaaaaacaatagaattaaaatggaaattccaagactaccgtagcaaatctacaattgttcaagcaatagggtacgatgattggttcaaaagtcccgagtttcccagtttgatgagataattttaaaaaagtgtccggtttcccgcgcttttttaagttttttgccaaaagttaattacctatttttttactgatttattaagatatcaaagtagaaatcatacctatttcaaatattgggatcgctaggaacaccatcgcgatttttaaatatcatttgttgatctaaagtgttaaattcaaccctttgtcttaatttttgcaacatcgttactaaaccaacttcagttaattgactgtttgcaaataacttgttatcactaatatgtttgttgattttaaaaattatagtttttaaaataactaatgagataaagcacaaaaatgtatgagctaggatatgctcatctattcttaaaaatacaggacgaatattcaataaaccttttagacttctaaaattagcttcaatatttcactgtttttggtatttttcaactatgtctaagacatttaaatttagtatatttgtttcatagacatagtaaccatcaaattgtttgtccttgtcaattttactttgatctaattcaaatttcatgtttgaaatttccctaaaatatttaggttttttaccaaacaatttgtttacttcaataaaaccatctttattttgttttttaataaaactttggatttgctcttcgcgagccttgctgtcttttattgctctttttttactgtaagtaataattcttcttctaatattttcagtgtatcttttatttttataagatgaataaaattcttcttttttatacttaaaatctgtatttagatcaacataatcgctaggatctaataaataatttttaaatttttgactgcctatctttgcacgataagaaataatgaaattatattcttttgattcaagaaatcgaatatttgcagcagtggacatgccacggtcagcaattattgtcatatttttgatattatatttagattcaatatctaatacaaaagggattagggtactagaatcggctgtatttcctttaaaaactttaatatgaaaaggaatgccatttttatcacatgctaaagcaatgacaatttgatcttctttgaatttagcatctttagaatagccaggaattcttaatccatttctttcaaatgtctcaaaatagactgttgatgaatcaaaataaaattcattgtccctttttccaagctcgcttataaccattttgttaagactatctaaaagttgattttgtgattcatagacaagatctaagagtctataaaagctatttttggaagtatttatttgatttgagtaatcatcctttttatcaaaagcattaataatgctaccaggatcagtaattcgctttgaaattaagtagttaaaaatttgtttcatatttttatgcctacttttaggaagtgattcaaaaatattgtgcttttcaataagtttttcaattaattccccaccaataaaaaccgaaccttcgattatggcagaatttttaagagaatcaagtaaagtagtcttgattttatctttgtcatctaaatttgaaaataatttcaatttttctttgataatttgaatagcatttggattaattttttccaaagtttgcacatttcctatactaaatcaacgttttggagctttcccataaccttgtgttcagccaacatatttatatattttatcttttgaagatcctcaaacattaaacaaaatcaaattatgctttttcataatttataattataccataaaattactttaaaattgtaattaattgtaattaataaaaattaaggttttacgggcaaaaaacaccgatttacggggatttctgcatattcatattcactaaaaagtgaattttcgccatcaaactgggaaactcaggaaaagttatattcttctaattgataaaaataaaattaatagtcttgatagtataaagtttagatctaccttttcttaaaattttagatagtttttttaaatcttcatctttttaacttggagattttgatcaaaaagtctctaatatttgcaactttgcttcattagatttaactcttatttttgcttagttggcagatattattgttttgcgctttaatcctggtagtcttaatttattccagaaatttataattataactagtggttgagttaacaagatacctgtttgagtcaattaaaatatctaaattgtgttcttgctattccattccgtgaaactttatcttaataaaaacaaccgccataatatgataaatattgacggttatttaatgattttgcaaaaataataattatttatatattttagcaagttgttctatactatttttgtttgctaaaaaactattaggaaaaaccaaaaaaaggtttctgcaatttatattaagtttcttggttctaaattcagtttgttattctttattattagtgaaattttatcattttaaatcaaatagtagagaataaaaactaaaaaatataaaaattagtgcattaatttataacaacgtcattaaatttttgtcttattttacattttttttattttttgtatagcaaactaaaattaagctgttcctatttgattatgcaatgagttaaattcctgtaatgttttgatttttatgtactttagctttttaatatcagtatttccaatatctattttttcaaatttttgaagatcattaactataaaattatctggttcaaccgcaaaattaggaaacaaatctttataattaaaggtataaattttaattatatctttctctatctgccaatataaaatctgatcgtcaaaaataatttttggattttgttttttaagtatgaatttattaaattcttcagagttgttatcgttgttaatgaacaaatttgaagggtgaaaagcctcgccccaatcccagctttttaatagcgaattattactaatgaatttttttgtttgatctaatgtagaaaaaatttggttttcttcagtgctctgctttgatagatctaaaccctgcatagcatataaacgagtaagttgaaaagggtttttcttaaaaatttcttgcttttttacaagaaattttttaaattcatttgattctttatggcgaataattttattgtaaagtacaagatcttcaatattactaatatgaatatctagactatgatcaaaaacatgtttgtttgacttatctataattttataaaaaatatcgaaatttgtagttgttgaatttgaaaacagagaagctctagcaaaattgtagttaattacttttggcggaccggtctctctgtacttttctcctgtacgaaaaaaattatcaaattttgagtcaaaagaaataatacttgtttttccattattttgtttgttttggaaaatatgattagggtttaatgatgatatttttgattttgaattaaacgatgaatcatcagcaatatcatgaggacgtatataaataataattgattttttcttaaaaaagtcaggtgttgacaaaattcttttacttagtttttcaatttttaatttagaaaaaaaagatacaaaatcatttttattatctaagacaacgaaattgtctacaattttcttgtcttttaattgcccttgatcccaaataagattaaattccattgtgtctttgtttttggcgctctcagaacgaaagaaacttgataattttcttaaagcgttattgttaaatgaattatcaaataaattgttttcaaatagggggtatttttgaattaataaatccactttttggggctgttttgtcaaaatgttatatcaatatgggttatttagtcataaaagtttattaagatcagttatttttttagagtctgagatactaaaaaatttattattatcatccttaattttaaattgggtttcattttttaaattatttttatagttattataaatattaagaatcaagccaagagaaaccgcggtagcggcggctaagttggttaatataaatcctattagaaaaaattttttatatttttttaaatccatgctagccttgtatttttttatatatattattaaattcttcgagtgaatttactgtttttaactccacatctttaatatttatatcaccaaaatcaattttttcaaacattagtaaatctttattatttaatttttcaatattttttaaggtttttggaaaaattgatttgtagtttaaagaatagagtgtaattttgcctgagtttttatcaatttctgaataaaaaacttcatcaagaaaaatttcatttactttttgagatttgagaatgaatttattaaatctttcaggtttatcaatatttttgctgggaacaaataaattagagaggtgaaatgcttcttctcattcaaggtttttagataaatttttattataaataaattgttttacatcgtcaaaatctaaaaaaatttctgttttgggttcatcttttgaatattgttcatttttggacccatataatgtggttatcttcaaattattacgcgctaaaattttctcttttttggtcattagatctaaaaaactctcaaattctgacgatgttttatctaagaagttatacaaatataaatcctgaattttatttaattttatagttgataaatcgtttgttttttgaaaattgttttttgaataaaccttaaaataaacatcaaatttatcatctaattttgtaattttgttactatttttacttacatctttataattaaaaagttgttctggtagtgaaataataaaattatgatttttataagtcataaatttaataggggacaattagtgggtaaatatttttcatttataagtaatgggttagctaatgttttctcggcaatatatataaataataaatttttagtaaaaaaatttttatcatattcattttttaaaaaggttggcttgtcaacatattccttaaaaaattcctcatactggttaaaatcattgataataaaaaaatttttagtaaatattttttggtaatcaccaaaatttggatttacttttaatttttggaaattttcgccttcagtagtagctttgtcatactctttggagaaaaaagtagacaatttattgaattctttgtcgttgtaagttttaaaattgtcactttcaaaataaagatattttttgattatttcttgaattttttcatggtcgttcaaaaaaatcggcattcagtcactatttttaagccaaatagtctttgttttatccatttgtattaaatcattataggaaaaaatgttagattttaaagctttactatcctttgcgcttatagtgaacaaatcattattggtagggtttgaagtttttgcttcaaaattgtaatttttattttgaagcgcaaaaattatagctgggaaaatccatggcaaaataattgaaggtgctaaaaataaatattttttgttattgaatgacatgtgaaaccgccaaatcatcatctatggaattttcaaacaaagaggatttatgttttttaacaactaaccgataaattcctgttttttcagctctataccttattaattctacatttgatcttaatgagcttccagagttcaatttaatgttttttcaaattcctccttcttttctttgcaaaattaaatcataatcactaaataatgtatctttttgtttttcaaaaagtgtttttctatttagccactcatcagggtattttgagttatactctttttcatatttttcttttaaaaattggttatatttattttcagtgattttatcaataaaataagaggcaccgaatgttaataatttataaacccaagaatcaattttactttcatatttttttaatggtttagttaatccagcattaaaggctcaagcaagcgaagcttttaactttttacctttttcaatttctatatctgggcttagataaacatactgactatcattatcatatgaaacactaaatgtttttaaatttgaaatagctttttttatgtttttaaaactaatttggccggctccaatagctgaatccaatccatttgacttagtttctctttcattatcgtagttttctaaatatgatttttttgctgggtctgaaaaataatcatcaattgaagaaacaacaccttctttttcattggattgttttgttgactcaatatataacttaattctatccaaatcaaaactactgtcattcgccgaagaagaaagcaaactcattattgcgggaataaaatttttatcattaaacattcacgaatataatgaatcaattgttgatattattccagttacaatcggtgcagaaaaactagtcccagaaacagggaatttttgacctattattccagttatattttctccgggagctgaaattaatggttttggtaattgatttagtctataaggtagtaatctattgctaaaattactagcaaaaaaattgtctttagtgccaaaagttgaaccaaccacaattgaatttagagcatttgcatacccagatatgtaaccatatttttttgcagaattattattttttcatttatcatcatattcatttccggctgcaaaaatgtttataacaccatactttcttgataaaaaatctaaataaaagatgtgatcgatgtattgaacaactgaattttccataattgaatcaaggttataaatattctcaaagctagcttcaatatctcttttacttatagaattaaatccataactatgatttattattttaattctatactcaattataagtctttcaaaaactgtcattcaaattggagagtcaaaatttgccttggctaaatttactataaacatatctgagccacgagaaaacccgcttcttccacctattattcctgatactaatgttgcatgatcattttgatcatcttttagcttttcttgtggcgctctacctatgttaaaatagtgtatttcattatattcaagctcggctttttttgcatcgttttcatcaaaggtgccactcatatccgcttcaactacaccaaccctttcacgtggggcgccattaacgtgatcatactctactatttctttttgttcattaaaaaattttggttgcacgggcctaagaagtcttcatagtttattatgattatcatttagtatagtatggaatcacttattagaaaaccgttggtttgtaattttaaataattcaaatggaaatggtttttcagaagttgttttcggtaaattattaattattaatgcaataaaatctaattcttccagaagtttaagggcgacatcctcgtctttaacatcgatatttattcatattattggcgataatttgctaatatatttactattaattttaatattattttgcaaaaataacttagttatttgatcgaaatatttgttattattagttgtataatgattaatgtcatcaatcatcgaattattggcagagtcactaaaatctaataataatttaatatttatggtttccgtgtctaatttttgttctttaaggttgtaattattcttgttctctttgtgtgaataactttcgaatttttttttagaattacggctgaaaatttttttgtgttttttctgttgtaaagaagaaaaagaatagcctggttgagaataaatatctatatttttactaaaaattgggttatttatataattttttttattattaataggtgtatcagaccaataaaacacagtaataattactattgcggataggtataaaatccatttaattaatcgtttgtatatttttttattcataattttatcgctttctaatttgcattttcttagagactaaacaatgactaaaataaaggaatattcatatctaataagatacaataacactaaactatgaatagcaaataaattatctataatataaattataacaatttttctagcttctaactcaaatggggataattttttttgctcttttttcatattttagtcctttatgataaattttatcaaaacagatttaccttaaaccacaaaatatttaatattctccatttttagtaagatctaaattgtggctaactatcaaaatagttttttttcaaaaagaattttaacattttcaagatcaagatttccagtaggttcgtccagcaaaataaagtcagatttaggtgctaatgatcgcaagatcgcgattagttattttagccgcctgataaatcactcattttattagctaaattttcttttctttattataatattttgaaattaaactaataagtttcggcaaattcttttttggatctatatttaaatagatattagttatataataaagccgattaaattgaatttggtttggtaaattagggactatttttaaaattgaatttattttttcaagttgagatttatcatctgtcatttttgcaaaagcgaaaatattattcgcagtttcgaaatcatattcattttgaaaattgttaatttagacataatataacctagaaaatttataaactatttttaagaagttcagtaacaggttttttgtaatatcttaatgatatgaaaaaatagataagaaaaataagtaggctagttgcgaatcaaattaaaatgaaattaataaaaatttgtgtataagttggactgataaaatcagcggttgttatcaaattataaaaatatggcatgctaggcaaacttattattagacctgatattaaaattaaggaagaaattacaaaaatatttaatatgtgtaagaaaaagatttttctagttttttctcctagtgatttaagaattccaattgattttatctttgattgtgttaaattttttgcataaagaactgaaaaaactaccaataaaactataagaattatttgaataacaagcaaaactgcttttattaaaaaagtggagcttaaaactaaaacttttattgattcaagatcttttgaatataaaaaatttgaaaaatcctttttaaatgaggctaaattttcattgatattgtcagattttaagaatatttttgcagcttgtggtcttatttggtttctatattcatcaccgtcattgtgcattatgatttggtacttaaattcacgtctttcttcttcgggggcgccaacttcagatttttgttcctgcaaatgatggttttcctttagatcaaaagttccgactattttaaaaggaatatcatgtccagttttgtttgataatcgaactttagaccctatttttagcatctcgtatttgtcgattttaaaatcattgtttttgttcaattcagtaattctattgtttaaattatcgataatattatttattttatcaatagtgttaactgaaacaacaatttcatctttatttttaggaagctcaccatcactaatttttaaattttctacctttaaatcttttaaaaaatgttttttttccacttccaatacttgaaaattttttgcatttaaaggagcgattgttatatcgttgaaaagcgaatcgccgactgtgtttttaacaaagaaagcttcattaattttttttgttaaattataatgtaaaaaagagggtattctacctaagacattagttgaatagtttattccgacaatagcaacttcaaaaattgttggaattttatcaacattcgaattacgtatagctttaattttaatttttttgccaataggatcggtaatttttaattttgtaacaactgaatttgaaataattatctcattttcattttgtataaaattaccttgaaggtttttgtcatcaaatttaaacctacttttaaaaaaatcagattggtcgattaattcaatagtatttttttcagaaattaattcttttcccttattattataagtaaaagcaaaattttgagttgaataaacaggaataattttattaacaatgtcttttttagtattgaatttctcgatttctccatcaaaaaatggtgatattcccctttttttaacctcaaaagaatccaaattgtattgatgaattcgttgcgagtcaataccctttgcatgcgtatcaagtgtagcaaataaatttaggcttaaaatgctaattagaaatgtgataactagtaaagttgtaataattattttatttttaaaatctagcttcaaaaataaaataattgatctaaatttatcacttatttttaaaggttttttttcaaatctaaaatcataatcagttttatttaaagattcgcctttatttatttcttcgattttatcaatttctaatacagactcattttttaggtaaattattctatcgccgtattttttagcaagatctaaattgtggctaactatcaaaatagttttatttttctttaatatttgtattttttcaaaaagaattttagcattttccacatcaagatttccagtaggttcatctaacaaaataaagtcagattcacgtgctaatgatcgcaaaattgcgattcgctgtttttgaccacctgataaatcactcactttatttgctaaattttcctttgaaatattaacaaaacttgcattttcttcaatattcttttcatcaatattaaaatttattgcatttgtcccaattttaatattttctatgccagtagcagattcaattaggttaaaatcttgaaaaacaacgtcaattaaagggtttttaacaactttgttatctttataaaaaagaatttcacctccatctttttgactaaaattagcaattaggttaataagagtagttttcccaattccagaaggtccaacgacaaagaccaactcattagatggaatatctaggctaaaatttgtaaaaatagctctttgattaaaatttttagtcaaatttttaatttttaccatttttaagtagccaatctatttgataagtcatataaatagttttaatattcaaaaagtgtgttttacctatttttttatcaattttagataaaatatctttttttaacaatgaaataaatttttctaatttagtagaatctatttggtgctctaattttgatttaattgtactttgaaattcaatataccaaaaaagatgttttaaaaattcagcgttatttatatttttttcattaagattttggtttataaattcaacaatttccttgttgtcgtctaattcatttttaaaaataaacttaataaataagttaataaattttaaaaaaaatggagcatttttttctagttttacatttataatattgtcaaaaatttgcttggaaacattaatttttgttggcttgtctgtattataaaaactatttaatagcgcaattgttttaaacaaataaaaaaaatcaattggtttttttacaaatttactataatcaattattgtatttaaaaaatctttttgactcttaaaaaaatcgggatgattcttaattgaaaaaaatacataattatataagtcctcaaaaaaatcaggattattttctggtttttcagttgtttgcttaaataaggtttctattgtttgatttattttttgcacttgattatcttttttctcactcaagtctaaaatctgttttacaaaaatagtttttgtgatgtcaggttcgtgagcaaataaaccattttcaatgccataatctacaatttcttcactttttttaagtaattcgggctctatttttttattatttccaaaataatagtaaagaagacctgaaccataaaaacttggatcgcttgataagctaaaatttattaaccaatttttagtaaagtcatttatttttgacaaatactctgatgagtagttataaaaattcttgctaaaatagtaaaaactaaccattggtgtgataaccaaattgctttggttttcttttctatctttattttcaataatttgtctaaaatggttatctcattttttaattaaaacatttattgatttttgtttttcatttataatgtctacaaaataatccttatctaaattattaattattgttaaaatagcgatatattttctaaaaagtagaaaagattttttttctgaagtttcatgaggttcattatcacttattagtacctcttcactttcaaaatttgctttcttaaattcatttttaattcaatctttaatatcgaaatatttttgaaaatcatgcccatttaatttaaaatataaaatatttcatgctagagcttgaaaatcctcatcattaatattaataaattcccttttgtttttgtcataatattttgaaataaaattaacgagtttaggaacgttattaattgggtcaatattaaaataaatattgcttatttggtatacatcgctcaaactaaattgtattcttcgtgataaattaggcgtagtttttaatattgatttaagtttctcaaattgcttaatattatttgtaatttttaaaattgctaaaaattcatttgcatattcgtaattatactctccctgaaaattattttttagagcatagtcactcttttgtgtacctttttttaattcgtcttctaaaataaaactgtttattttttcttgatcggaattagaaaaaatagatgcagattttgaattactagttaatgttttaggctcgaatctatttatttcaaccgcaataaagctattaaaaccataataaattaatggcacacttatagcaattgatcccaaactagcgccaataatagaaaaaataactcatttttttgtaaaaattttaggtatcatacctattcttctaaactttcggacaatcatgaaactctatgataagaagaatcagacaatatacttgcagttttatatttatatttggcatgtgcagacgctgaactaccaaaggtcgttactttgtattttcaaccatgaaaatcataatctattcctgcatatctatgattataatcggtaattgagtcaaccagatatccatttgagtcaatggaaacacctgtatttgcacttgccttagccgaaaatttaccatcgtattttatttctcctcctactgaaaacgaaggacttcccattccagaaattcaagatgtcacctttaattctaatttgtccgggttagaataatatgaatttcttggtctaaattttgttcttgcttttccagttcatgaaattttgtcttgataaaatcaaccgccataatatgataaatgttggtggcctattaatgatattccgaaataatagtctttatcatatctttgagcaagttgtactacattattttcgtttgctaaaagcgcaattcctggaaacaataaaaaacccttcgcatttattttttgactagcaacaattgccggtgttgtgactgcaagcgttaaacttgttaatgctgttaagtttagtaaaattttttttattttttttgtaaagaacataaaatatccttagcaaatttttactcataattatattatgctaaattaaataacaaagaacaaaaacaagaaaaatacaaaaatataatttttgttaaaaaacggtaaaaattatatttttattcatattctatttttacaaactataaattctataaatataaaaaaaggggaatattaaatattttagtcctttatgataaattttatcaagacagatttgccttaaaatacaaaatatttaatattcctaaacaaactttaattaaacaaatataaaattactcctttgagtttcaattaagggggttttttattattttaaatttaaccctttgcaaaaaaaaaaaaaaaaaaaaatgattggtctgaaataaaattaagttataattagactcacttaagaataattaataaatttttgatgttagaattaaggaggaattaataatgtttttttcataagaaaatcagaaaatgcgaattttccactatttttttaaatataatggaatgccataaatttaaccgtttagaaacctacaaatttatggcttttaactattgttctttcaaaacttcaaatgtttgttttttaggctctatttaaacaagaataagctttttatttaaataaagtttaaatagtagttgtattttttttatgatttttgttattttatccataaattgatttgtgccagtgttttatactaaaaaagtagtttaaatacttcatattttgctttttaagttaaaattttagcttttttagtttgctttatttgattaataagtagatttttcttttatgagtcttagatttaaaattcagtgttttttccttgatagtcattattcctgagtttgccagtttgatggcaaaactaagacaaagggtttaatttaatacctgaaatcagcaaatgatatttaaaaatcgcgatggtgttcctagtgacccgaatatttgaaataggtatgatttttactttgatatcttaataaatcagtaaaaataggtaattaacttttgccaaaaaagttaaaaaagtgcccaaaaccggacacttttttaagattatcttattatactgggaaacttgtgaaaatcagccaattcacaaatttattaacttcaaaaattttttaccaaaaaatttttttgtgttataattattactaataagaaaaaatcattatttttagttatattcttcttacaaaacttaaccctttgctaatcatttattcttaggagccattcttttgaacttttatttcctttaatttagaagtttaaaaatttgaatctaaattaatagtaatcctttttgttgtataattatagtgttaaatctttgttactttggatcagtactcaagaagctttaagaagatatgttggaaaagtattaagggttcaagaaaacccgctcaggttcaaaacctgtctgatccgccatattagcttccgtgggtaaattgctatacaccttagatcgagattctaatccggaaacgagtgcaagttcaagtcttgtcgagagcactatgttttttaaatttaaatagactttacttattattttataaaaatttcaaattaattatcaataatcactaaacggtctataagttcgctaatgagtccttgagttagatcgattaatgaaataatagcaccagcatttgaaagtacagttgaagctaataatgctggtctaacagttgtttctatttttttaacattctttgcaagagttaaaactcctcgaagtcatttgttgacgcttccaacaataccaattgtatttccatggcttgctatttgttctttgattttatcccttatatcaaaaggggctttttgtagttgatcataaaattctttgtattttgctgaaagataagtaagcattgaacctgccgcaccggctgaaatagcagcaacaaaattaagagcaaaaccataagccacagctagtgcaaaatttatggctgcaaatgaagcagtttttacatgtgatcttcatactccggctgaatatctattataactatcattgttctgaggaattccggaggcaggtattctacggaagcttaattttctaggatctcaagggaatggagtacccatagatcggcggttttgtggtttgtatttgtatgcaaatgttactgatggcattttgactttgtgttgatattgtttttttaattggtcaaaattaatgccttgtgtagctaaggtgtcttttgcaagtttttcaagatttgcccttggatttgcttttactttattaataaaattattaaaaacttttttaaatctaccaagattgccaatttttcgcgcttctagttcaacatcttgaacatttaaaaaattaatgctagaattttgttctagttggctaataacgttattagcttctgaatctaaaaaattgttaaattcttcattataagttagacttgttgaatctttttgaagccaatttttttgggaaataacagaaattagtggaacactaattaataaactagcaaaaattaaattggttagtaggcttaggccaaaaatttttttaatatttttgttttttattttcataaatcacctcgtttgtttgaattaaaaaatttagtatatatccttattatataataaatattatataataaattttttgttttcaaatttttttctttgtttcttttcttaatgaaaaaatctggagtgtttataattttgtgttttgaatttttatggatttctcaaatagaaatctaatttaattttacattatttaaccgattagggaaaataatttctaattgttttttaattatgtctcaatttcttacctgcctttgtcattttttagatgcgttttagagcgttaaataagttatttttgaaaggtaattcacactttgaattccgcttagattatcacaagaaattattagaacatcttgcagcccacgagtttttagttactaaaaacatcaactcaattacttgctgattccctatttttagcccaaaatcccagtactctttattgtcctgccaatcaattgcaagaataagataaagtgattttttgagaaaaacaccgttttctttaacattaaaaaatatcccatcagtctacaaaattggataggaattctcaattttttgcgatttttacttttcaatttcaggtaataatttgttctcaaaactgcgatttcgatctcttggtatttttagatgaatattattactattataattcccagttttgcccgaaaacccgtttggcttattcagtctatgtacaccattttcgcttcggttacttttttcatagcctaaatgttggcttaattccgcctttaagagcgcctaagcaaaagttttagacatatgcgaaatttcgttgtgaaaatctccttttttaattttttatgatcagcgtattttatgataaaatttatcaaaacagatttaccttaaaacacaaaatatttaatattccctactttttatactaattaaagttaaaattaatttaataattttatatagttcaaataaatttaaaggacaattatgaaaaaaatattaccttttggtttgctaatgctcttgggctcaatcccagttattatagcagcttcaatcaacaaaccaaaagaagaaaattataattcatatgctaatatgaatcacaaaaaagataaagtaaacgtttctttattacgcgaggaagcaaaaaaaacattagatcatattagaaaattagatgctaaaaactttagcactaattctgaggaaaataaccccacaaaaattgttgattttacaaaatttgaaaatgattttaattctttcctggataaaattgaaaaaatcctagtgtagatttagaagaattagcaaaaacacagcttaaaacaaaagggttggatttggacaaaattattaaagaaaattctaaaaacgtcaaaactgaatcttccaaaaacaccaagattaattcagttaacttttcttcttattcaaatactgattctacgacctttgaacaattagcaaatgaaatttgaaatggtcatgtaaaatcatcagtttttgctgctatcaattatgctcttacaatcgcttatggcttttcttgaaattttttaggcgccgctgcatctggaatagccgctggaactttaacttatttagctgttgaatataagaatgcttataataaaataactactgaccctgagtgggcaaaaattaaatatcagtttgttagtattttagatgattgaaataagggttatattcaaggaataaaatactctaaacttggtattgttatcatagttaaagtaatcaatcatttaagaaatgaaatattaaaagctagaccaattttactatctgctagttgagtgtctactaatataaaaattgccattgctataattgatattattcaaaatataatttgaagatacgtatgaaaatagaggttaaccaatttaattagataatgtttaataaggaaagtttagaaaaatttttcaatttaaaattcaataattgaattttttttattccattttttggtactaatacctattataaattattcgatttacttgtagaatacaacagttttgagccgattttatattataaaaccagactaatttcatgacttttctatttaattcttaatttattttcaattattttgaccattttattatttttgttaatttttgtttatagagttcattttttttcttttggtgaaaattttgcttttagccatgaaaataaacataattttttttatgactataatatttgatttccaaatattatgaatgtggccatatattctttcattgcattttttgggttttttttaaatgctttttgagcaaaatttgttatttacttttttaagaaatttttataccgaaaatataatttgaaaaataaaaccacaacctttgaatttttagaaaattttaatttagaatcttttgtaaattccgttcttgttgacactgaaaattgtaaaaaaaagaggaagaaatcaagaaaaatttgttgaaaatatcaacataggggcacaataattagctttctaatagaaggaattcccttccctaaacatactagacgttttgttaaatataattatattaagtcaaggaaccgcaaggaaattagtgaatttgactgggttgtaactgaggtgcaaaaccattattgattttatacatttgtttttgcttcaatttttaataaaaatgaaaaaaattttaacagaaaaaagtttttctactacttatttaaaattttatttttttatattttatcaatttgaattcttcttttttcaacaatttttgtattctttaatcattttcttcttgatgaaccgacatttttgttaaaaatttcagcattaggatctgttattgttgtcatttttctattcgttgttatgctaaaatctaagtttattgagtggacataccgccgcatcaaaaagcgtttttttgacgctaagctaattaagtctgaaaaacaagattcaatataactatttttttaacaccattatctaaatgcccttaaattagtggaaaaattcagattattgctttttatttatgatttttattccactgtttttgttaatttttggcattttatttttaaaaaatctgaataaataacttatttaatataaaatttgagcctttatatgaaaaagcaatagttacattttcaaaatttttacttcaatattggttaattttcattggaaaaacccaaaaaattcaataaaaatgattgcagagttaatcctgcctttctaagaacatttttggattatttcttgataaatttaactgtatttccaaaaaacccttaattttctatttcttttttgtgttagcgggatttatttttcatagacttatcaaacttttttgccaatttattattaaattgtttcatatacatgcaaaactgaccgtttgtgtgaaattttacatttttcattattgattttttataaatttccctaaattcttctgcaaaatgtaaaattttgcttttaaaacctttaaattccacaattttgctgtatgcaattttgtctcaactgttaattttaattgtttcattttaacaccttttttgaatcaactaaaaccaacatactaatttatagtttatctaattttacatttttttgtctagtctcattttttatagtaaaacttaactcataaacaatttgtaaaggcaggccggattatgaggtttagcatttcaccaagagagtttcaaaaggaagacaaacaattttattagactataaaagcaaaaaatattttccttttgtaagcggataaactggcttagaaaagaaaaaatccttataaataaaggattttttcaagattaaaatattaaactatcagatggaattttatatatggcgcgcccggaaggagtcgaaccctcaacctcttgggccgtaaccaaacactctgtccaattgagctacgggcgcaataacttttggaggcaccaaccggactcgaaccggtacatcaaggtgttgcagacctatgccttaccatttggctatggtgccagaaactaaaaatatttttacattgaaattatagcagaaaaaattaaatttcaaagaaattatttttttatttttcttgctgtcccaaaattcggattagaagttcgattagctcctgtttttttaaatcttgatatccagaaatttctagttttttggcaatttcatataaatttgtcaatggtaatttttcaagtgcaattctaattttttccgtttttgaaattggtttttccgtttttgcattatttatttcattatcaacatttaaatcagaaggatttgtagtattattttggtttgtctgatgcggattattttgagccatactaaaaatatccatatattttgagtaagtttggggatcattttttagttcattaatttgtttttcaaagataattattgaatgtgatagtcgaaaaattgatttaattttcaaaactcttgtataaaaataaggtattaaaaagaaaacaagcccgacaagaataatctgaattactaaaattagaataaaatatttgtcatctttttttaaatctttaatcattgacactgttgaatgcaaaattgaaattaacgacaagctaaacccgattaaatttacaaaaaaagaccgattgccaagactagcaaaatccttttctttataagaaataaaaagcgaaatgatataaaaaaataaggtagcaccagtaaataaaattgacaaaattgataaaataagttcaatccttttggaatcaaaatttaatatgatttgcacccctagtaaaattgcaagtaaagcaagtaaaataggataggtaaaaattcaaatccgatattgttttttttcattttttcacaattctgccactgacgggatttttttattaccaaatggatttcctaaaatcataaagtccttaaaaaattttatttatttacatatataattataattcaatttttattaaatattataaaaaaataataattttaagcaatataaatttgctctttcgtcttagttaaataaaagttcctattattatatgaaaaaacccggaattacaccgagttttttcatatggtggaggtgcggggaatcgaaccccgatccaaataaaaaaaattaatagagtcgacagtttaaatttatatagaaataaaaagtttatttaaaattaagaataagtaaaggagtaagcattcttaaataaaactaaggaggataatcttataagtttgataagtttgattatctaaatttaaatatttttcaagttacagaaatgggaggcccgtatacatgataaaatttaaatttttaaggatatattataataaattgattaaacgtatgcaaaatttaattggttatatgataaaaatgggtaatcaatttttgcttcgtttggagatttttttgaattttttgcgttttgattatttcggtattatggtctaccaaaccactgcatcttagaaattttttttaattgtcaaaaccaaaacacccccatttatattagatatttttttaaaaaaaattgtaaaaaaagtttttacaaagttaattataacataaattttaaaaaaattaatttttttctttgctttttttattagctcaaatgataaagtagaaaaaggtatgattgtgttaatttttttagttttgatatcgtatatataaacaaatttggaataataaaccaaaaatgtattatcgtgaaataaaatcctaatttttaatatttaattgaataattttatttaaaaatttaaattatttggtatttgatattcctgctgggaatcaattttttgttttcttatatttttattaaattgattttttactaaagaatcatctcaatttgattcaatttccagttaataataatctaaaacttgactttttataaaaaaaattaatttattttttgggccttagctcaaattggatcagaaaaaccgtagtttttaataacgccaatgatttttttttcactatccttattattgccataaaaattgtcatcaaaacctaaaaatgttattttcttattcattattctatcaattaaaatatttgcaagctcaacaataaatcactttgtaaaattatttacaaggtcaaattcaataagtaaaattttaacatttcttaatttatctaataaatttagtttattttcataaatatagtgactaatttccgacaaactaaaaaaaccaacattatttgagtttttcgcaaaaataatagcaaaagattttaaaagttctgaacgttgaatactatccccaccttttaaataaattaatttatgggtagttatcatttttttaaatgagtttttatattgttttaatggtagaatttttttagattttgggtaattttcttttacatatttagcaaacttttcagcatttttaaaacttatttctggtaacaaaaagtagtcaagccattttttctgaacaaaattttcattatagataaaggtagttttactcacaagccttccagtgaataaatttcgcactatttcgtatttataattaggtttgcttagaaattggattgctagccaaaaaagatcaagattttcgataaattcttctttagtaattgaaagattttgtattcattttgcaaaataagggtttttctgtgcggaatcataactaaaatcaagttgcttttcatttctcatattgtgtttgcctattttatttttgtttgttaataattgattattgaattattattttgattttttaaattaaaaattattttcttaattttcagattattgtttttttattagttaaaaatacgctataattgcattaaaaatttaccttataaaaaactaaattaatacaaatttgataatttaatatttttttctttagagtcaaccttcacctgaatttaattcatcaacaattcagtcaatttcccctaaattattttttgtttctaaatttgaaaatttactatttttttcaagttgtttttcatcttcgatgtaaactaaattatttttgtttttcaaaataagtaatttttgactatttttctgtttctgtttaaaaatttcttttaattcaatttcaacatctttcccattaattattttattatctcataaatcatcaagaatttttttcatataattaaaaattatttgattattagttttataacaataatcaattacacagttaattgcataatttgaaaaattcctttcattttggtatgcttttaatgcatttcgcacccgtggtcgtattattttttttgctagatatagatgatagtcctcaaaatccaagcctttttttgctttttcattatcaaaatcttctggaaaagtaagtaaattattaattttttcgctattcaactcaaagagttcataaaatttttttgaaagattacgtaaatttaatgtatcaatttgcttatttttactaattttttgtgtatttttaaatttttgaattaaatttgtatatgtggataatgttattttttgaacaattaatgatttaagatatggatttttatcgatttgatttgaattcaatggagcctttaaattaataaaatattttttttgttcagaatcataaaatgtttcaatcaaatttagtgattctaaaatttcccgatttttattaaaattttcaaaattaatttcaaaaattttttctaaaaattcataatccactgtctcatcaacatttttaatacttaaaaggtatcgaaataatgtagagcattgcgatccaataatcggataataaaagtataacaagttatttaaatcatttttgttaaaatcaaatttagaaattacaaaacaaggatgcataatatttacaaattttattattatttaaaaattttagaaaaaaattttaggaaaaatcccggttttttccattttcgattggagattttgacatcgtaaaattgaattttgcccgtgtttagggcctgattttttaatttaatatcgtttttgactttttttcttttaatgtttaaaagttgttgttttttactggtattaattcaaaccacctttgaaaaaaatttgccgaaatttgcattctttgttcataaattcggtatttcaacaaaatgataatgatttttgcttaaatgattttctaaaaaagggtatattgatttttcgatcagatcgcgattttgcttactttttaacataaaattacgaattttattcttattaacgatattttcattaataaaatctggtctgattttcttgattattttaaaacattctccgctagctaaataacaattatgaaaaaattcatctgtatataagacagaataaccaaatttttcaactttcttcaaaaaagttgtcttcccactgccgtatttaccaacaattgccgcagattttggctctagaatgaaattattaattacttttgcaaccccaaattttcgtttataaccgataaaatcagcattttttttagcattttttgcacctgattgcataattattaacatttttacaattttttttgttgaaatatcattttcggaatcaccaatatgtaaggcataatctaaagaaatattgctaaatttagtgataaattcgactgcttttccttttgaagcgctaatatccgtaatttcgataactctaaattttctaatcaggcaaatttgaagattatcagaaaatattttttctaaaacgtaagcaaatttcttaatttttcaaatattaaccgaaaaaatcaaaatttttctaacattttcagggaccaaaatttgcctaaatggtctaaaatcgaaactttttaaaaaaaagttcaaaaattttataaacaaatttttgaaaaaaaatactttcgagttaaatgaaattacaaaattaaatctttttgtaatttcaataattttactaataatttcttgtttaattccagttttaaaaagtgtgctaaaatttttatcaaaaatttcagcaccattttgacaaatataaaattttgccttaatttgtctaccaataagggcaactttggaattaaattttcttcctgttgaaattacaatgatacatttatttgctaattttctaacagcatccgaatttttctttgaaattcatgcttttctacccctgccaatatctaaaagtgtgccatcaagatcaaaaaaacaaattttatagaacatatttagctcaattttttagatttttaactataattataataaaaagtggtaaaattattacttaatttgaataattatttgtttagatttcttaaaaagttttaaaaaactatatattataatataattttaaggctacaagttaaggattttatttttatgaagaaacaaaatatatttcagaaaattgctaatttaaattctaatataaaccaggaaaaaccaaaaaaaactccaaaaaataacaaaaaagtttggatttcaattattgctgtagcaggttttctaactgttattggtttaggtgttggaattccgctagtttattcaaatgttcctaaaaattttttatataaaagagatccaaaattagatattatccttcttaaatcgccaaaaagtaataaaaaccttaaagttgaagacttattaagtgtttttagatccaatcatttaaaacaaaaagaaaatttagaagagggtcagaaatatttaatcgaatttctttataatcaagaatatcaagcatccaaagttttccaggcagcttgagaaaattctaattcagataaaacgaccgggaattcccgtaattttgctcttgaatcatttgctgaaatccgtgaaagtcaagtaaaatatcttcaagatgaaagagctagataccagaaaactttcggctttaataattgagaatctgaatttaacaaatatctaaattcagattctcgttttaataatgccattaattttgatcaggcagttgatgctcttacaattgaaaaagctcgtgatgttgcttttggccgatttaaacttagttttaataaaaattttaccaaaagtgatattcaggaccgggtattaaatgatgatatcaaagatgaaaaaggcaaaatagtctataaaaagggtgataaattatttaaagatattatcgaaatcggcataaatggctttattccaaatattataaataaccaaaataataaaactgaagagcaaaatgtgactgcttttttaagcaactcttatataaaagagtatatgaatccccaaaaaattattaatgagatctattttgatgaaaaagcgcctttaaaaggaaatttcaatttttttgaaatttcccagattagcattaacgcaaaaccaaataataaggacgcaaaaacaccttgggatctatcaaaacaaacacttgaagaattattaacttataaaattcttaaaacagatgataataccgaacttgccctaaaagtaagtaataatcttgaattaattgagaaatttcaaggcggaaattctgaagatagtagccaaaataatcaggacaaaattctgctttcaacaattgattatcaaaaaaacaaagaaaatgctgctgtttttggtaaacagccaattgcatctcttaatcaaattcttaataataacgaggctggttatgtttttgctttccttggcgattttgaaaattcagagaagactgataatctttttagcaaagttttatttgaaaaattaaaacttttagtttttaaaaatagtccaagtttgttagttgaacctagtttattaaattcaaagtcaattactgaaatcaaatccttaaatgaaagactaaaaaacttcattcagggactttcagataacgaactaaaagaagctggcaaggctttcttagaaacttttggggctagtcaaaatgatacgcgtaccaaattagtctataaaatacgggataatttaaatgttgtccttgattcaagtgggatgaaagtgcttgcttataataaaattgcaagtcttgaagaatttaatgaaattattaaaaaacagttacaattaagcgcaaataatcaggtggatcccaaacaggatgcaacaattaatttagaccaactttttgctgatatttccaataatgatttcattcaggcgctattaattcgcaatttagaatatctaaagaagctttccgaggcaaaaaaaactcaatcagaacaagataaaactgaatttttagaatcaattaaacaatctgcagctaattatttaaatttttatattcttgatcaggttttaaaaatcaatgcaaaacttcaggattatatctcaaatgcaactttaaatgatttaaatgccgatttttggtataataatcaaaatgagcgttgggagctaagatcagatccaaatactgaacttcgtcaagcgataattaagcggcttgaaagcttgtttaaatttagctattaaaagaaaggataatttgtgaaaactcgattcaaaaagaaaaaaaactggtatacatctctattttttctagtactaaatttttcctttcttagtcttagtagctgcagagttataactgagacttcagaaaaagcacaagaagataaaaaaattagttctgaaattgtaaaaaattatatcgagaatgcttttgttgaaaacattttacaagaaaatgttttcaaaacaacaagtccaaaacttgttttagaatttgaaaatacaaattcggaattttataaaaatacaaaagaagcttttaatttttatcaaaaataccaggttagccttgatccgactttttcacttaaattagtcgctgatctccaggaaaaaaacgcactttcaagcgcagattttgccattctttcagcccaggcaggttataataaattatttgatagtcaggcttttattattttatataaaaattttgctactggaatttcccaaattgttaataagatgcttttagtaaaatattatcttgttagtcttggacctgatttaataaaagattcacaaatttataaggatggaattgcagcttcagcctcttttacaacaaaggaaatttttgaaaatatagacccaaattctcctgattttttcctaattcacctacttttaacgaaaaatccggttcaaatttgacaatttgaatcaagtgatcaaagtagtatttcaaccttttcacaactaaaagttaaggatctaaactcatttaacaaccttttacgcagcgaaaatattacttcaaaacttacaagaaaagaaaaagactttgaaaaattagcaaaaaatgatagtcttgatacaacaaatatgcttggatatgccgggattttgtatcgtcaagatgcaaatttagcagatttaagctttcaatttgaagatttacgcaagcaaggcgaagtcaaatccggctttttagatccacagtcaaatcgaatttgatcttctgaacaaattagaaattttagcctaattaataaagcgaaaatgtttccagtagaactaaggccaaattttgactttaaaacaggtaaagataaggtccaaatttctgattttgaaattaaaaatgataacagtcttcctgaggcaaaatataaaattaaagcaattatcccttctcgagaaggttctggtaataatttttttgttagtgtaattgttgagatcgaacttggttcagcaaaatatttttataatgttgatgttagttgggatgagacaaaagcatattattatcctgaaattaaaccccaaggtgaagatcttccaaaacttagtcaaggaatcccaacaacttttaaagatctttcaaaaatttcggttaaatacgttaataaattagcgcctttatatgataaaatagtgcaaggcgaaaacggaaaacgagcctatttttctcttgaaaatacaccttgaaatacccaagaacaaaaaataaaactcgcttattctttatatttagccgatgagaccggaatttatcgggatgcaaaaaacttttttgaaggacttggttataaaattgaatcaaaagacgagattatcaaactagattagcgctaaattttactaaattagacaggaaattatggaaaatactactttatttctagatataattgcaaaaaaattaccagcaaaaataatttatgaagatgaaaaagttattgctttttatgataaatttccagtttcaccaggtcattttttggtcgtaccaaaaaattattcacgaaatttatttacaattagcgatgaggattttacctatttaatcaaaaaagcacgtgaattagcacttgttgagctaaaaaaattaaatgcaataagttttaaattattaatcaataacgaaaaagaagcacaacaaacaatttttcatactcacatccatattattccgttttataaaaaagattaactagctaattatcacaatttaaaaaaaccaaaaaaatttgaatttttgttttttttattccttttttaaataaactttattgatttgatcaactaaattatatctatttgtcttaagtgcaattcccgaagacatatgcgaggttaaacgaaattgatcataaaagagagatctaacatttccatttattgttaaaatcgatccatttataaaagctaaagttccatcggcattaaatacacctgaacctgaggctcctggcccattagaagcaaaaaagtttgccgaaattagtttagggttttgtgggttcctgcggaaattaacacctttaaaaacgttttttgaaattaaattattagcccaaaacatcccaatttttgttgtataatcaaagtcttgatcatctcaactttgttcagaaattttagttggttttaattttgaaattttttctcaatattttttaaattcattaaaatttgatacaaatttctcaaattttccatttgctagggtatgaattgtcttaattaaatcttgatgattggtctgaaaatattttattaaactttcagtttcactaataaattttgaataattaaaataaaaaacagcaacatccaaaccttgattatcaaaattaggaacttcaaaaaagttgttatataaattttgcatataatcagttaattctttgattttacactctcgacaatcaaccgggaaaagttctttgccattatctttgagtcattttgtttcccaaagacgaaaaagaatccgattatctagttctttaattttaaagtcatcatagtattgtaaaaatttttgtaagttagcattaagggaattaccggtaattttggtattcattacttttcaaaatgggccaccgttatggtaaggatataaaacgtgtctgttagttaaaaaagcggcttttccggaattagcgtttaaaaaaactgcagttccaggggcaaaccgaatgtttcgagtaaaaatatttgcatatcttttttcttcaagactatctgatttaaatccaaagtaaggtagaatataataatttcctagtctatttgggttaaaataggaataataatttgcttttgcattaacattatcgactaaattattattcattttttttattagaaaaatatttaaattatcatttttctgacctaaaaaagtagtttcattttctttttttataacattttcccaatttttaagctgatatttataataagttggcgttttagcaatattttttacctcatttttgctaaaatcgctttcgctggcttgtgttagttcattaacattaatttttgttgaatttggatttaccttagcaaaatcaaaactagtttggtctgataaatcacttgtagattcggaccaaaaattgctatcagtggtttgattattttccgttctttctgttttttctgttttattttggctatttactacatcttttttttgggtattttcttcaactggacttacttttgattcttttgttggatctaatttatcttcacttttttcgggagtttcttcacttcttatttccggtaatatttttttcttagttttgctagattcaattttataagtacaacttagaactaaaaaaggacttatagaacttaaaactagaaaatattttaccatttttttcataataactctcgcttttacattaaaaaattatcaatttttactttttaaattttaattctgttaaattaaaaaacataattaaaattataacaaaaaacaagtaaatttattttttattttagatatgccttataaatctcatcaactaaattataatccttagttcttagggtaagtgcagatgacatatgcgaagttagcccgaattgatcgtaaaaataaggcccgatactacttacacctaaaattgctttgtttaaaaatgcaagcgaaccatcagtgttaaaaattccacttcctgaggctcctattccgttggctgcaaaaaattttggtgtaattacatttggattgttacttgaattttcttgatcttgaggctcaggagaaaaataaactcctttgaaaatattttttgacacaaaattttgtgcccaaaacatccctatttttgttgtataatcaaaattatcagcttctcatattttatcagaaattttaagaggttcaaattttgaaattttttttcaatattttttaaattcattaaaatttgatacaaaattatcaaatttttcgttagcaggtaattcaattgaatttacaaattcttgaccttttgccctaacccgatttattaaatcttcaatatctttaatgaattttgcataattaaaataaaaaattgcaatatctaaattattatttttaaaatcatgcttttcttcaaaataatcatcatataaattttccatatacctatccaactcgtcaattttgcctcaagcgggattatacggaaaatttttatcatcaaatcatttaatttctcaaagtttaaaaagaatgcgattatcaagttctttaattttagaatcatcataatatcgcataaattttagataacgaggattgatttggttattttggtcttttttattcattagttttcaaaaagtttgaactgaatcaccaataacgtgtttgttagttagaaaagctgctttttcagaattagcatttaaaaatacagctgttccagcgccaaaacggatatttcttgtgaaaatatcagcgtattttgtctcttcaagtgaatcagatctaaaaccaaatcaagggagtttatataatctagattctatcccccccaagataaattaaaatacgtaaaaggatttttttgggctctaatatcgctaactgaaatatgttctgtattttttagtaaataaatatttaaattttcgctttcttgacctaaaaaagtagtttgattttcttttcttataacattttcccaatttttaagctgatatttattataaactggaggtattggctctaaggagtttttatcagtctgacttggatctaattctttaaaatcagtttgattagtttgtgatagtgaattagtattaatttttagtgaattttgattaatttgaaaaaaatcaagactagatttttctttttcttgatttttttcaagttcaggtaaaattttattttcttgttctttcttttcttggtctaagctatttgcctcctgtttttcttcagtttttttggtaatattctttttagaatcaattttatcattacaacttagaactaaaaaaggacttaatgtgcttaagattaacaaatattttagtgattttttcatattttagaacccctttaaaataaaaaatttaaattttttaaatattattttaattttatattataatatttttttattaataattaaaattaaatttacagaaacgagataaatatgacgcttaaaagttcgcgaaagctaggtttttttgcagccctgtcaatgttagtaagctcggttgttggaatcgggattttctttaaaaatcaaagtgttgcggatataacaggatataatggttatgcttgactttttgcttgaatcatcggtggcataatttcactttttgcggcaattactttttcagaaattagctttttaaaaccaacaaagctcaacgggctgccaaattgaacctgacaaaccgctggtaaaaaaatgggttatggtgttttatttaattatagcttttattattcaggaattctaagcatagttttaggatttttttcttctgaaataacaattttctttcttcaaacagcaggggctgatattaatgttccagtttgaggccatctaataattgggacagttttttgtatttttttcactagccttaattatatttcaataaaaacatcaggatgaattgcgcttgcatcaacaattttaaaatttattcctttagtatttgcagtttttgcaggaattctatttccaaaaacttataatgccggcggttctaatgcctttgttcaaacagctacaaatagttttaattttgcaaaattaattcttgctttgcctccagttttatttgcatatgattcatttttatctgttggttcaattcataataggatcgaaaaagcaaataaaagagttccaataattattatagttgggatgataattattgcggttgtctatactttgattggtttatcatctgcattgcataatcagggcacaattagtggcttgattagtgatgtttttccaaaaagttctgcaaaatcaattagtatttttgttggatttttcctactaatttctacatacggtgtaacaaattcccttagtgcaacctatgtaaattcagttactgatttagttaaattaaatgcgattgttggcgcatttagtcttaaaaagaaaatgagtcaagtaaaagtgacgatttgttaccttacaataattttatttttttgggctttaattatttatatcccttcagtttctgtaccttttccatctgctaataattctggttctggttatggtactgatgttgttgttgattcgatgtccaattttccaacattaatttttatgtgagtttatatggctgttattattgcttatgcacgaaaaagaaaacaacttatggattcatcaaagcaaataaataaaacattattttgaacagctgcaataatttcttctatattaattcttacagctatggttgcatatatttatgcacaaattgatgctgtaacaaatgaaaaaaattcaagttcaggttctggtgtttttgcagctaatgggcttattttaacaaatcagggaaatttcttaattcttatttttcatttatttgtttttagcaccctccctttcataaattatttattaataaaaatagttgataaaattaatgtacttgattattttaaagctagcgaaattgaaaatttagaaagcaaaacaaccactagaacataaacttaaattgttaataaaataaaattatcacataaaaaaagcgctaatttagtgctttttttattgaattagaacaaaaattttattttaatatttatttttctattagtaagactttaaaaaaccctttaatttatagtattttttatttatgttggttttaataatttcatttttataaaaaaaactttttattctatttttaggtaatttttttataatttataaaatttaattttaacagggagtcaaaaatggactttttaagtaaaaagtttcttttttgtggttttaataagctaaataaaatcactaaaaatttaaaaaaagactataaatttatagtctttttttgttttatggtcgataaaattatctaaagtgcataaataattaatccaagaattagacctgctaaactaggagcaataatcggatttaaggaataagaaaatccaaaaatctcttgccaatttttaatggcagcaaattcctttcttctttttaaaactagattagcaaaaagaaaataaactaatcttgggccaaaatcacgggcgggattaactgcatatccagtcgaagatcctagtgaaagtccaagtgagagcacaattagtgcaacaattactggtttcattgttgaaaaagttttatttaataaaaaaattgctgctaataaaacggtagttccgataaattcatagaaaaaattagatatatatgattttttaaaagcagggctagtatgatggcaggcagcgataatttctgcttttgtttcctttatatgacttcagttgataaaatttagaataacttgagcaaaaattgcccctaaaaactgaaaaggaatcagcgcaagtaattcgctattttgaaaaataatgccaaaaaatattgaaactgccggatttagatgagccggcgcattttcgataattccatttgaaataattattcctaaaagtaccccaagagctcaacctagtgcaatcacaattcatttcccagattgatttgcaaacattttagtcgcatttacactataatttacgccatttccgagtaaaattagtatcgcagtcccaagaaattctgataaaaaaaagagattattcatcttggattcctttttatttaatatcttttttccaatttagcgtttttctaacagctaagtcccaattggaggttaatttttttaccataaattggtcaaattcagggacaaaaactttttcaggaactaaaatttgctttaattcagctagtgaattccaaaatttggcatataaacctgcaagaaaagctgctcccattgctgttgtttcaatattttttggcctttggatttcaacctgcgaaattgatgcctgaaattgcattagataatcacttttagaaactccaccatcaactttcatcaagctgatttttgttcctagatctgattcgatcgccttaattagatcatttgcctgaaatgcaattgattcaagacttgctttgataagatgttctttttttgttcccctttcaagtccaaaaattgccccacgcgaataggagtcccaataaggtgccccaagtccggtaaaagatggaacaagaataatatgataatcattttttttagcttttgagactaaagaatcgcaatctgaagagttttcaatcaaagaaagtccatctctgagccactggattgcggctccggcaataaaaactgatccttcaagtgcgtactggattggattatttccgatttgtcaggccactgttgtaagtaaattattctttgattttattagtttttcaccagtattaactagcataaaacatccggttccataggtatttttaaccattccaaattcagttgcaagttgaccaaataaggccgattgttgatcaccgattagtgcataaattggtacttttgcttttgcattaattgatcaatgaaaaggagaaacaaatccaaaatcatctgctgatgctaaaacttttgggagaatactgtaaggaatttctaaaagatcaagaattttttggtctcattttcgtttttttatatcaaataacatcgttcttgaagcgtttgttatatcagttgcatgtacttttccgttagttaattttcaaagaagtcagctatcaattgttcctgctaaaagattaccagcagctaaaacttcctttgcttttttaacattttttaaaattcagcgaatttttgtcccgctaaaataaggattaataattagacctgttacttcttttatataattttgataacctttttcaattaaataatcacaaaaatcactcgtgcggcgatcctgccagacaattgcattatagactggctcgccatttgttttatctcataaaacgacagtttcccgttgatttgttagtccaagggcaacaaaatcagtcgattttaaccctgcttttgtttttgctgcctgcattgtatagacctgagtattccatatttcaatcgggtcatgttcgactcatcctgatctgggaaaatgttgactaaattctttttggacaagcgaaataaccctacctttttggtcaaaaatcaaacttcgacatgaagttgtccccgaatcgagggtgataataaatttttcagctgtattttttagcatttttttaaatcctttcaatttttatatatttgaattataacattttaatccaaagtagccctgtgaaattaacaattttgttaattttttaattatttttgaaattaaatcttataaaataataaaatttagaaatttcattatttttttataaaaaaaatttataattcttccttctatgatataataatttcaggtaaacagaggtgtccatttttgggctgagaaaaactcttattagttgacctaggtaatgctagcggaacgagtttgtctttttttaattgaatcgtcataaaacaccttagtttactgaaattttaaaaggaaaactgatttatgatggttaaaataaataaatttaattcgaaaaaaaagcatttttttaaaaaaataacttttttttcgtcattttttctaagttcactgctttttatttcagcaggctgttcatctacaagtaatgaaaaagtagcacaagtagcagatcttgaaaaaaattgagatacacaagtaaatcttggtcttggtcaaagttgatttgaggcaaaatcaaaagatccagatcgggtttcaaaatttttagaaaatttgaaagccgagtttaataaattaaaaaatgcaaatccagatacaaaggatttgccaaatgtaaattttgattttgtcggcattgatgattcaaaaactaaaatatcacaactaaaatcttcagataattcaacttcagcgattgattttgcaatcattgatgctaccacaacaatcgaagacgatcctgaaaaagaactttataacggactgcaaactttaacttgagcttttaaaaatagttctgatagtccagttttttatcaaaatgggactaaaaatgatcctttacgccaatcagctaaggaattaagcgatctttttaataaaattccctatgatcaatggaaaagtactcaagaaggcgagcaaaaatgagacggtattgcctatcgttttttatatgataactctagtccaaaacggataatttcatattatcgagggatgattatgatagcaggagatgattcaactcgcgaagagatcaagaaagcctgagatcaaaaagactgggaaaaatttcgaaattttggaattatccacggaaaattaacctcagctggcaaattcaaaatgcaaaattttatcattaagaaacattttggtgctaattttccagcaaaaagtctaaatgaagataggataaaccatccggataaatatcttcaggcttatggatcttcaattggacaagatccaaaatataaaattgcctttgatgatgaagcttcatttgcttgaactgaaagcaaaaatgataaaaaacagtattattcaaacgaaaaagacggaaaaattgagattttaagcctaactaatcccgcttcatatgatattggttcattccgtccaagttttaataaaattcaggccgatatgattactgaagcttttgtaaatcttgcaaagaacgacaatgatagttatggaccaaatgttggttataatggatacaaaaaaataaatcaaaaagatcctgaatttcgccggatttatgcagaatctaactaaaaaattctgtcttgaattaaaaaatttttcttataaacatattaaaaaaagcaaaaatttagtagaaaatctaaatttttctctttgtagtggtgatgttttatttgtgattggcccaagtggtcagggcaaatcatccttgtttttagcactttttcagcatattttaacttcaggcgagttaatttttcaaggaaaaaatttattaacagagtcaaaaattaataaaaaaaaagtggccaagtcaattggatttttaagtcagacggctacttcaattaattttcagagtgtttatgcaaatttagtcaaaaatttgccaaattataaaaacattttttataatttatttgcaataccaacaaaaaaacaacacctagaaattgaaaaaattcttgataaactagggctaaaagaaaagatttacgcaatttttcaggatttatcaggcggtcaacaacagcgggtagaaattgcaaagctgatgttacaaaatccaaaaatcattcttgccgatgagccaacttcagcactagatccgaaaacagcaaccaaaattatcgatttaattattgaatttggaaaaaaaaataattcaatcacattaattatttcacatagcatttttttagtaaaaaactataaagaaaaaatattacttattaatgaaggtagaggaaaattttataactcattttctgaaattaatgaaaatatgatcgaattaatttttggtgaggaaaacaatggctaatttattccctaataaaccttatcaaaagtttaaaaaatctagaatcatcctattttcgatctttataattttatttattatttctttttattcaattttttccaaaattaataataacggctgaaaaatttttcagaagaaccttagtaatttatttagtttttcaaatattcacccttattataatgattcaatttttgctttaagttttaaatttttatgaattacgattaaatacacgcttgctggaacgttttttggaacaatttttgctttttttactgcaatttttagctcccaatttattaaaaataaattaataaaaatccttatttggtgagttattataattttaaaaagcttcccaattatttttgtaatcgacccgatgcggctaattttcgccccaaaattagcagcttttttaattattttctgatttagttgaatttgactacaccgttattttcattcatttttaaattctcttgacttaactagttataaaaaagcagttatgagaggccaaaattggtttatttcctttaaaaatgaagtttttccctttgtggtcaacaaattttttgggctttttttgtttagttttgaggcaaatatccgttgaacaacaattatttcggcaactggggttatcggaatcggaattttgatcaatgatggtattcaaaattcagctctaggctggaaaattattggaattccccttttaattcttttattttttactattatttttgattttttaattattttttttaataaatttattctacataaaaaatctgttgacatccggcaaaaaaattcttttattttatgaatcaaagtcaattatgaccgaattttaaaggctttttttataatttttttattaatcttaatcattattagccttactgatattgaaaattgatcggtaaatacttatcaagtcaagcgtttttttaattccttgtttgtttttgattgagaagtttttttacttggtaaattagataatcctctttatatgatttgacatttcttttgccaaatcattgtttgtttgacaataattgcttttatttcaattttttttgcaattatggcaaacgaaaaattaaataatttaccaaaatgactgatttttaaatttcttttaaatctctttcgaatcatcccctcaattattattttctatctttttgttagtttcacggttagacctattttgtgagttacctgtttagttggttttaaaaatggaataacgatggcaaaaaagctcaatgagacactaaattcgcttgactgagagaaatatcaacttttaagattaaagcaatgaagtaaaaaaaaagcaataattcattatatttttccttcaatttctcaagaatattttaaatatttaactattgaaattgctaattcagcacatgatttactcctttatggaatttttggtggttcaatgcttgggcttaaaatttcaacactttcacagacaggaatatccggtgaccgtggtggtttttttacttattcatggattgcttgatttttgatattaattattgaagttactctggctctaattgaaaaaaattatttcaaaaattttctctatttgaattcaaaattttggaatattttactaaaaacagtaagaccgaaatttttctcaagatttaaataaatatctagtttagtttcttgaaattaataaaaataggaaaaatatttaatttttcctatttttttcttttttttcaaaaaaaagcttaaaaaatttaatttaggtaaatgcggaaagcacatattgttagtttggttattctaattggcggattaatcggttttggttttataacatataaattacaatcacatatcactccaaaaaaacaaattgcgattacaatttctcacggggttcgcaatccaggaactaaatttttcgactatggggtgaattgacggaaagtttttcaagaatttgatgttatccgtggttatgatattagcaaatataaccttgatttaacagtgaaaaacgatcaacaagtcgaactaaaaccaagtggttttttaacaaaaattgagaaaatttcgcttaaaaatgcggaaaaattaaaaataagtcgagagatagttgaaaaaatccgtgattttttaaaagaaaataaaaataaaaaattaacttgaaaagaattggagtgaaaattagaagttgattttgaaacactaaagaagctgcaagaaaattttactcttgactagcagtttttcttgggctaattttcctgattttaacagttgataaatttaattttttatgaataattttattgttttttctaattttttttctaataattctctctgagtttaaaaaaattcttatttttatgtttttagcgggaatttttttaataatttattgactaatgacacccaaaattgataatcaagctctaaattttgaagctaaagtagttgataaggtgagtttcggaaattttgttgaatataaatctaataaaatttttattcggggacaaaaccaggaaattggaactaatttatgaatatcaggtgtattatcccgcccaagaaatcaatcagattttgatttagtaacatatttaaaatcaaaaggttcacttttagttcttgataatccaaaagttaccgtgcttgagacatctaaaaatatttttacaaaaataagaaatttttttaaaactgatggtagatattcaaaacaattaatcccgatgattttcctagcagagacacctccagaagcaaatgattttcgaaaatgacttgtaaatcttggtatttatcaaatctttgttatttcaggttttcatattaacctttttaaaaaagcaatttttggagtttcgaaagcttttaaaatcaagccttttatttataagccgattttttttgcttttttattatttcagttatttctttttaattttgctgtttcttttttaaggggttttattttttgaagtttaattgagattaataaactatttttaaataaaaaactcaataaaattgagctattatcaattagcgggatagtaattttatcaacaaatccgttgattttttattcaattggttttgttctaactttcacaatttcctttgttattttaattataaatcaaataagcttttcgaaaaaatgacataaatttatagtgcaatttctatttattaatttttttagcgctgctttttctgcctttttaaattcccaatataattttattgcccctttaaatgtagcattgtttactccattttttacgcttttatatacaagtttgtttatttttattttcaatccaataattattgagtgaatatgtaaaagttttattcaaacggttgaatatattaacgattttcagtttctaacttgaaatattagaccaagcttatcatttttgcttttttcttgtataatttcgttaatatgttttttgtctttggaagtgacaattacattgtccagaaagaaatttcaacaatcgcagaatctgaaaattctaaaataattaattttttcattaatgattcatatgaatttattaagaaaaatattattaatttttcgctctttgacaacaaaaaaacctttgtttttaatgattttttatacttttcaactgatgagagcgcaaatgaatttttaatttcaaaaattaaaaatacaaatcatacaattatttttaagtatattcttaatgaaaaaaattctctttctatagttaaagactcaataatttataaatctttttcagataaggcaaaaataattcatactttggaaattaaccaaaagaatattcttgattttatcaaaattagcctaaaaaatttaaaaattaacttaaaaacaagtgaaattattgagcttgaatcacgcctgccttttaatggtatgataattcaaagtgaattactaaaactaaaaagtctaaatttaccaataaattctaagataattcataattttataagcgattattcacgccattcaacatgaggttttattaattcatttgtaagtttggatttaaaaaacaccttcggattttaccgccaaaaaatattagaaggtcaaactttaagtctgttaattgggcagataaatgcaaaattaacgcttagttttttgatttatcttgaaaaaaagcttggtcatagcaatttagaaatttctcagaaaatgggaatttctaattttcaaataaacaaagcaatcgatttatataccaaaattagtattgaaaaacttgaaaatatgataataaaactggcaaaattagatactctaataaaaaaatcacaagtcaatgataaattagcttttgaattgtatctacttgacctcattaaatagttttttttggttaatttttttgtttgttcgggaacaagatgaataacttagaaaaaataatagatttttttgttactttttcaaaaaaaaatgtataatgagggtaaatgttgagcacaaccgaaaattatttgtggttatttggtcaaagttttacaaggattggccgagataattttgataattttttgttgtgctttttttataaaaattttatgggggaaaaattgtagttaaaaattttaatatctaattataaaaatataaattcttgctaactaattttagaaataataggaactttttaaaaaaaaatgaataaaattcaaaaaattaaatcaaaatttttaaaatcagcactaattttaagcacaattttttctgtcccacttttaagtgcggcttcttgttataaatcaaaaaccgaaaatccggctacacaatcacaaattaacaacccgcttcgttatgatactgaattagataattcaattgattttcgaataattttttctggatcagatccaagaaataaagctttgaccaaaattttacagaaatgaaacgaaaaacccgaggtaaaaaacaatcaacctggatattttcctgccaaaattgatcaagctattgcaaattatcaagatgatcaaacttcacttacaaattatcttgaggcaaaagaaaataaaaaattacccaatttaacgctaaattatccagcacttgcaagtactttaaacaaatacggaatgcttttagattttagtagtcaaagagatttagatgaaaaaatcaagtccgaatatgatgataaatttcttgttgaaatgaaaaatctccccggaattagcgctgaaagaatcccgttattaccaattcttaaaacctcgaaagtgcttctagttgacaaaccagttttatcttatattcttgaatctgctaaaaaatcaagtcaaaatttcaaaattgctgaatccgatcagcaaaaagttaaagaactagatccccaaaaaaccgattatgaatatatttccaaaatttggggacaatatcaaaattttccccttgatcaaaatggttttgatggatatacttttagttttgaaaaacttaataatttcagtgatattgttgattttcttagtagggttaaaaaatcttttcccgatgcccctaaaggtccgctaactgaaaaagtcgattttcttattggttttaatgatgcagctgccctatttttatttgcagcttttgcagttgccgatggtaattataatcagtcaagttattttcgtgatgatgaaaaacagctactaaattataataatttatttaataaatcaaccaaaaattaccaaaatactaaaaaagcctacgaaattatggcaaaattaattaaggaaaaactagctggtccctgaaaaaaatcttatgccagcgattatcttaaaaatcaccagctagtttttgccctgacttcttcaagtcattatagtcgtaattttgaagaattaggtcaagtttttctccgttttagtaaagattctttccaatttgactatccagttggatcaaaatcaaaaatttgaaaactagtagatcaagaaaatcttcccaaaaatgcgattgccaaagtccaccaaattcttgataacaaacctggttatgtctatgttttagcacctaattctactagcgaaaatgatatcatccttgatccacaagttgatgcaaaattaattcaggaaataaaaaatactataaaaacaaagggcgaaattaataatttcagctttttaagttcagatcctgattttgaaaaatgacttttagaaaaaaaacagacaagttctgatcttgccagtctatatttggattttggccaagaaagtaaatataaactaataaaacaaagtaaaaatgtcactcttttttcaaagtcctatcagaaattaaatgaagatgaattaatgattctccctgaaccccaaaaagtcgaaaaatcaaataaattcaacattctcaccctccagggtccttcactgattggttttcataataacgaaaaagaagatgttgccacacttaattttgttaaatgatttatttcccaaaaagaggaatttctaacagaaaaccagcaaaaacttgaatcaacaccagcagattttctagcatttgccgcgggaaatttaaatccgacaaaagcgaatttaaattcggattttgaaaaaaatccactatttttgcaaaatccaatttttcaaattccgcttgcagaattcaaaaagcagttagaaaatccagaaaaataccgtcttttttcagaaccggccggagttgattcaaatacatttcgaaaaaccttattttcaactataacccaaattaataaccaatttttgcaagatcccgaattagatcttaattttgattatttccttgagcagttaagagcgaatattgccctatcagtgaaactggaaaaagatcaaaaaaattcgcaaaataaaacagttaaaaattaaaaattatggagaaaattataatgaagtatcttaagaaaaataagcagaaagttaaattatcctataaatttaggcgttttttcctaaccagcgcacttagttttgctcccttggctttagttgcaagttgtgttaataattcccgatttgattcaaatgaggataataaattagtttttggtcatactttttcatcttcaggaaaagaagcaaaagcacttgagaaaattattgaagtctggaataaaactgcaactaatcaaaaagattttatcaaaatggaagcacaatatttccagaatggctataatggatcagcggcttcgattacaaactttttacagacaaaagatcggataaaactgccaaatattgtcacaaattatccttcacttctggcaatagttaataaatattcaatgacttttccgcttgttaaagattttagttctaatcaagaaccacaagatgaaaatgaaaaagcaataaaaaagttcctaaaagagcaaggaatttctgatttccttgaaattaataaagaagttcctttccttgatacaaagggagtttatacccttccatttggaaaatcaactgaagttcttacaattaataaagttttgtttggttgaatgattaataaagcacttgctgatccaaaaaagccagcaaaaattaaagaagaagataaaccttattttgccgaatttcaaaaattagccaaggaaaaaactggtgatattaaggaaattgaaagaatctgaaaaaaatatgtctcagatgatcaaggacttgcaggctatgaatttcgccgatccgatcttgaaaattttactgacctacagaaattatcatcacgaattcttcgttcttttccagaggccctttcaggaggatccactgattcggcaaaatcagttttaggaattgataatcaagcaacgctagtttttgctcttgccagatcagtttcagaaggtaatcgatcacaggaagttaccgttcttgataggcaaaagaatttaattgattatatatcttttatagataaacctgattcaattagatataaaaatttagaaaaaatttttaatttattaagccaagggataaaagatcgctcaatttattatacatctgcaggggagtataattcaacttttttccggaatcatcagcaagttttctcaattggttcaacttcaggctatttccataattttgtcaaaccaacagcgacaaattatcaaatcggctttaacaaaaatgatggtcttaagtcagtttatagcgttagctatcccaaatttagcgcaattgtatcacttgaagatctcaaggatataaccaaagatctagaaataacagcaaccgatggtagctctaaattaaaaattgatgctaaatttttaggaaaactcaaagaatatgcacagcaaaatccagttaaaaaagtgttttattttactgatcgatcagaaaaaccttcaggtatcttcgaaaaagattatattgttttaggcaaatacaaaaatgataaaaatgaagaatttaatggccttgtaattccaacttatacagaactctataaaaattctggatcaaatgcccttaatgatgatgaacttgcacttgaagccccaccgcataaattcgatgcaaatagtaaaatcacccccattgtcgcccaaggtcctgatctaatttttattcattcaactgaaaaagaagataaagccgcaaaagcttttgttaaatgacttttgacagaaaaaatagtctttgaggaaaatagtcaggaaaaaatgactccgcttgagtattttgccagagcaacctcatatttattgccaataaaatcaacgcttgataaaacccattttagtccaaaaaatagatctcagaaattcatacttgaccaatttagtaaatttcttaatgctgattcaaaaggaaaatattcgcttgtctatgataatgccgatgcaaatgcttcatccttccgtgaatcactagattcttcagttgcccagatgcaatcattaaaagcaagtgatggaaaagtgcgtagttttaaagagtttttagaaaaactagagggaaatttaggtcctgcttttaaatcaaaataagcaaattatttagttttttaaaaattatgaaaaaatttataaaaaaattactttttagttcaagtgcaataattttgtcacctttattttttatttcttgttatcaaaatgaagcaactcgtttataccaagaagcccaaaaatactataaaatacgtgattttttaaaaaatccctttaatgatttatttgatcaacaaagtgattatgcaaaagatattgcaaaatttttagatcaaaattatcaatgaactcaacaagataaactaaaatttaaagatgataaattacctgatcaacaatattttgataaaatattagccgaaattgttgaatgaaaagatggagatactgtcatattaaaatcacttaattctgaaaaacttccgcaactttttagcgttcgacttgaaagtatcgatactcccgaaactggaatgattaacaaagatggtaaatacgaaaaaactagcggagttgaagcaaaattcgctaataaagcaactgaatttgccaaaaaaatactgcctgtaaaagcaaaagtttattttgtttttcataaaactggcccatcacgttcttatgagcgttatgttggtagcatttttttcggccatgatgaattttataaaaattattcccttgaaattgtcaaagctggtcttgcagctccaattctccatagtggatttagcgcaataaatgatccaacgacaatttattcatatctttcgatcaaacaagcatcagcgcttgagaatgcaattaataaaaaattcggcgtttttgagggaataagggataagaaatttaattcaattactcaagttcttgaagaaatatggaagacccgaggtctccccccgattagtaattttttagttttaggagataaaaataagaataaaaatgttgttgactggtatgaatttggtcgagaattaaaggaaaaaaaataaaaaacggaaaaaaatgaaaaaagataatgaaaatctagactaccaaaatgctgattttgaatatgaaattaaaaaaattcggcaggcggccgaaaatcgttataagtcaaaatctttgattccagcaattgaaatcaaagatctaaccattgattttggtgaaacacttgcagttgataaggctaatcttaaaatttttaaaggtgaacttgtcacccttttagggccttcagggtctggaaaaacaacgattttaaacgcaattgccgggcttttaaaacccacttcgggccagattatttttaatggggatgatgtaactagaaaatcacctcagcaaagaaaaattggacttgtttttcaaaattatgccctttatccgcatttaaatgtttttggaaacatcgctttttcacttcataatgacccaagatgaaaacaacgagcccttgaaaaatctatgcacgcccaggtaaatgctaattcgattgttttagcaaaaaatggcgcttcccttgaagaacttgaaaagtataaggcacttttatttgattattttaatgtttatcgccagttagagcatgactatagcgagcttaaaactgaaatgtatcttggcctaaaccagctcaaatcagattatattttaattgatgcccataaacaatcagaaattaaaaatctaacaattgattttctaaaactaggtagatcagcatcaattttttgagcaattttaaagaaaattttcaagaaaaatcaaagtgaaatctgcccaatccaacaggcaatttcttatcggaaagcttataaattaaagctaaaaaaaatcagagaaaaagcaaaggctgataaaaaggactataaaaaccgaattattcaggaaaaatatgcaattaaatatgcccctgaattagtcaaagcccgtaaaatttttcttgaagaaaaatcacaattatttgaaaaattagaaaatcttgaaaatttatataaaaaatttaaattaaatgcgaagttagaattaacaaaaatcaaaaaaggttataaaaaatttcgtactaaaacgaaactaaaagatgaagaatcactaaatcttgactatcaagaacaaattgaagccttcaattttcaaaaaaaagaaaaagaattatgatttaaaacccaaattcaaaccgaaaaagcattaattaaaaatgagaaaaaactcgaaaaactagagcaaaattacattgaaaacaagaaaaaatttctagaaaataacagagctgaatcaccaaacttattacttttaaaatcacttaaacaaaaaattaaaagttataaagcccaaactttaaaacggtttttagaatgagaaaaaaacctgattagtaaattttcccttaatatcgaaaaattatcagaagctgaactaaaagaatatcaggaatataaatcaaaaaatatttcgattaaggaagcaataaatcaggccgtacttcagacagccgaaaaagttgaaatcaccaaaaatctggctaaaaaaccgacaaaattatcaggaggtcagcaacaaagagttgcaatcgcccgtggaatcgtccgtcatcctgatattttattaatggatgagccactttcaaatttagatgcaaaactgcgagtccaaacaaggcaatgaattagaaaaatccagacagaaatcgggattacaactgtttttgttacccacgaccaagaagaggcaatgtcaatttcagatagaataatttgtatgtcaactggttatattcaacaaatcgggactccaactgagttatatcataaacctaaaaatgaatttgttgcttcttttttaggtgttccagaaatgaatatttttgatgctttctatgatcaaaaaagtaaacgcgttgttattgacaatcaagtaatttacgagaatttagaaaattatccctatgaaaaaatcagagccggaattcgcgctgagcatctaattgaagatgcaaatggcaatttttttggaaaaattgctgcaattgaatatctcggaaaagatatccaagggaaaattgaaattacaaatttaggtcttttttcgattattttaaagaaaaaaccaacctatgaaatcggcgaaattatccagtttagctttaaaaatggcaaattacatttatttgattatcaaacaagggaaaggatctaatgaattttatcagcggttttttttataaaaggcggattcgcaaatcgcgtttagaactagggattctcgatcaaaaacacccgttttgaaagccttttttggtgcttttaccttcaattttagtaatttttttatttacctttctgccttttctttattcaatttcaaaatctttaacaattgagatcaaccataatatcgccggaaatacccgttttggctttgataatttcattgatttgatcacaattgataaaaattttcattatgcaattagaaattcagttgtctattcaattctagcccttccttttggtctaattattagtttgataattgcatcagcaattgcttccttgcaccgaaaatatgcccgtggattttgacagacgattttttttatgccctatgtaacctcaggaattgcgatttcagttgcatttggttatatttttgatagtgaaactggttttattaacaaactttttggtatttcaactagatgactaaattcgggcaatcccggttcgctgcatgcactttttgtggtcttgatctcgggaatctgacgtagtcttgcttttgaagttctaatcctaacaaccgcaatgttatcagtaaatccaacactttataaggcagcagcaatcgatggcgcctcaccgattcgacagtttttcaaaatcactttacctacagtttcaaagacaataaattttttgatcacaattggaatcatcggcggaattaaggtatttccggtcggaattttcccaaatgagaccgaagcaattacaaatggaggatcaactttgcttgtctatatttataaaaatgtccgcggaacgcctaattttgcccaggcaggaacattagcaatctacctttttattttcggaattgccctttctataacagtaaaaaaatttttaaatgggatattttgaatatctaataaaatttcggagagatatgtttattctaagattaaaaattcgcaaattcattagcgatcgcaaaactgcaagagttattgaaaacattaattcccaggtcaaaaatgataatttaattagtgcaatttttaattttatctttaaatttatagtactttttgtttttggtatcttcattattttccctttttattttatgtttgtctatgctttagcccccgaagatcagattcttgatacccgggttccggttttttgacctaatcaatttacctgggataattttacaaaagctgctcagtctggttattttaaagcccttggaattactgcgagtgtatctttaattgccgttgttggaaaagtatttttttcaatgacttttggttatgcattttctttaagaaaatgacgatttaaacagttatcctgagccattttcttatcaattttagttcttcccgagacagctttaataattggccagtatcgaattatggtaatgcttggttgaaatgatgggtttcagtcaatttttgccctaacagccccatttattgcctcagttttctctggtctaatgttccgtcaagcctttgaagaaattcccgatcggatcaaggaagcctcaatggttgatggctgttcacgaattcgctacttttttaaagtcgcaattccaatggtaagtccaacaatttgaactgtcggaattctaacagcattagccgcctgaaatgcgacatcctgaccacttgtgattctccagtcaaattcggcaaatgttcaaactttaaatatctgattgctccaaaaagttggtgttgctgatgagacaatgcaagtaccaggaggatattttaaaaacatccggatggccggagcgcttttggcggttttgccaatgtttatcgtctattttgtttttagatcaagaattatgaaggcagtttcccgtcaagaatcaacagtgaaaggttaaattatgcttaattttaaaggatttttcaaaaaacagaagcaaaaaattaatcttttatttcagtcaggatttatttggttttcgatgattagcggccttgtttttaccggactaattatttgaggaattatttatttttttcaacaagcttttactgatggatttttataagcaaaaattattgaagaactttgttatatttttcctaatttaatatttctaaattaggaaaaataatattaaagaaattatttaaatattaaaaaagttgactaaatttagtcaactttttttaataaattaggaataaataatctgttttttaaattttttattccatatattcgctaaggaatttttcaaggatattattatatttttgattatcttttggtttatcaaagagggcaaaaccttttagtgttattccggttggttttctactatcatcttgttgttctttgtcaatattttcttgattgttgctttttgttgtacctaaagttagatttttagctagatcgagattttgaaattggctctcaattttggcttttcagctaaaaatttcctttttccctttttgataatcacttgaaaaaagcttcattttaaggtatttttctgcattttcgctttcaactgttgcaaccagaaccattgtagcagccggagcattgaggaaatcatgtgatttatctgattgatttttaggataaagcgcaactttattatgttgaagaagttgtaaaaggaaatcatgaacatcttgataagttccgttaaaagttttttgcagcccacctgaggcatcggtccattttaattgatttttattattttgctctaccttttcaaaatcagcaccaattttattaaacccggttagtaatatttctggttcgattaataaactgaattttgaactagaattatcacttgcgcttaatagaaaatatcttaaaagtgatcttcgtgataatttagtgggtttaaaggcataaaaaattgtcttaccctcatcaagtttaagattttttgattgttcttgacttgagttttcaagacttattccaccttcagctaaataaataccggcttgatctagatgtactttttgctgcgatttatttgaaggttctggatttaccttaaattttaaattcggattatttagtgcactaatcgatgcaagtactggtttattttgatatttttcggttgttgtagttatatttgatcgtcaatcaaggaataaatcggtatttgtactttggactaatgcttgataagctttattatcaggggcaactttgtcaattttgatctcaagtgtttcttttgttattccttcaacttttagttctaattttaaaataaatttatcccgataaaaagttgataaatataataaagtgtttgtcgggaaactagttttttctaaattttcaaaaagtttagataagtaagttccaccattttctgcctggattgttttagtttcaacttttggtacttgttcactttgatcagtttgttcactttgggaatctttacttgatttttcttcttttgcttgacctttttcctgactttcttgttgttttacctcttcattaaataaaactgcaccaactttttgcattttaccatttggtggagccatttttgtttctaatttttcatttttacttgttgaaaaattaagaaaatcaaataaaggactcatttttttagtaattcccttaagttcaaggggtttatttaaaagatgggcaatttttgtattaattgttgaggcgaaaaccgttactggaagatagcttttgacctcaagttttaaattatcaagattttttgccgttttagcatcaaataattcaagcgcatttcgaaaatatccagaataaatttcttgtgttgcatcgtagtcaaagtcgaaattataattatattgtttatcttgagtcaaatttagacctgcaggaacttgatcatttactaaaaaagttccttctaattttaaattaatagttaataaattcttattctgactaactttttcaggttttttaactaaaaaagctgcttttttggcctcaaaattaggaattaaacctttaatatcagcaaaaaaagttgtatttggcactgatttttgaataaatcaggactcaaatttagttaaatcaagactttttggattagaagacaatgaaaataattgtgcaatatctaagttatttttggctaggtattttgaaatttcactattaaattcatagtttttcaaaaaacttgctaaaaattttcccccatatttctgatttgtttttgggagatcaacaaatctaaggggaaaaattttctcagttttagctgttttatcatataaaaccatattaagaacaagctcatttttttcatcatttatacttgcaaaaactagtttattatcttttagatccggtttgatttcaaaattttctggaaggataaaaattggttcagaatttaggctaaaggaggccccaccaaattcgccaaaagtttcatataaggcaatttttgaatcagaaagtttattaaaccgttttagtcaagcattataaaataaaattgctatttcagttgcggtttttcctttaagtgattcaagatttctaagactaatttggccagtgaaattttcgggtagaaattggaaagccttttcttgacctgagaaatcaaggtcgaattttgcagtataatttatggtttttgaatgattagttacattaagtccgatattttttagcttattttctttgatttcaaacctggatttattatcagggataaccaatttaaaacttagatcaggatatttttgacttagactacttaaatcaactgcatcagctagatcgaaactataagatttatcaaagtgaaaatttagagcatcaaaagcgtttagtcgcttggcaaatttaggttttacctttaaatttgcaactaatttatcaaattcagcactattaaaattagttcttgaggtcaaattttgtgcttttccaagatcaatgttataagaatttagttctagattatatttttcggcttgggatgaaagtgcataaggaattgtaacagcaagacttataattgtactaattccaataattgagaaaattaaatattttagcttgttttttttcattttttctcctttttattttaaagcaaatagtgattctgaactttcaataataattaccctaactggcttacttgagtgaatctgtggctgatcttttttgtatacatataaatcaaaattatgtcgtatctgattgccaagttgagatattgtattagtaagaactccgggaatttcttcgctttgatgaatttcttgttgttctggtttagctgctactggcttggctgctgaaggttttgcagcaacttttgctgcttcaggtttactactttctaaatttttacttgtttttattatataaaaaccataatctgggtaattattttcaaaaaattgactaaaaggtagatttttgatctgattatcaattttaactggagtattttccgttttaattacttgttttatactatcaacaagttgggtataatcttcttttttaaggaaaataatttggtctgcacttggaaaattagtagcaatttcatttaatttttctacatcttcactaagcaatttattattttcattaactacaagatccaaagtttctttttttgtttggtaaatcacttgaattaaattcccattttgatcaactgaaccaattttatatcaatattttaatcttaaattattatttggattagttttttcctgactaactgctacatttaggcttataggttcgagttcaaactgaattttatagtctaaattttgcccgagtgattcagcaagaagtccttgatcttttgaataaataagcgaataaaaagcaactagaaattcactaagatttgtaattggatttttacctttttcttggataaaatcttttggtttaattgattttgcaagttctcttatatgttcgacaaaatctctcgtgttaaatgcgctttcagttttgattaagtccaaagtattttttaaatttgagtgaaggtaaaaactattattaagataatcaggggaaattaggtagtcattatttaatgaaaaaagtcaaaaatcggaggtcagtgaaactgcttttttctcaggaggctgaatttttatttgacttaaatgtttaaataaactattttggtcaagattttcaggccattgtgtttttggatcaattaatttaaatttatttaaaagatcatatcaatattttgcaacaaaactgatatccctttttgcaagtaaagataaaaatgtactaacctcttgatttgttttaaatgacttattccaaagattaataattccctcagacattttctcaggaactacacttaattttgcaaattcttcaacattaggtaattgtgaattatgaactaataattttaagcgatcttcgttaaattcatagccataataatcaccattttcaaggatattttttaatttatcaaatttattggcatttaagagtgcaagaatttctgattttggcgcacccttttggtttgcaattttttttctagtttctggtttaaattcaaattttgtctgtttaatttgctttactaattcagcatcattttgcccgagacggtttagatgttcaatagtttgggaaaagtttttttcagcgacaatttgattttcagcatttctaagaataatttttccgaaaattttggcaacaatttggttatttttaaaagccaatttagttgaattagcatctaatttaatatctaattttaaatattttaaaaattttgcataatcaataccggataatttattttcaaattcaacttttttcagaagcggagttctaacaatttttgctataaggttcttgagaaaatcttctctctcgttttgagttgcaaaaatttggttattgtaataatttagaaaatctcaaccattaatttcggcttctaaatttttttcaaaatttatttgtgggtaataatcatcttcagaaaattcagttattttaatattttcagcgactgttttatcaaggaaaaaattattaagatcaatgttaattccaaaatgaaactttgaacttttattgagatcagccgcaatttttttagcaaaattcggcgaaaaagcagcataaaatgttaatttataaattcctttttgacctgtttttgctaaaaaatcctgacctaaaatttgatctcttacaagttcaatctgatattgcggatttcatattccactttcatctagataagaaaattctttattattaagaatctcggcaataatttcttctaaattaaaatatttattaataattttgcgggcttcattattatttattgcccagtttacttgcttttcaaagtcttctaattttactaattttgtaagttcttttttggttgataaactaaattccttgttggtataagctcttagtttttccaattttgaacttgaaaaattagcgaaattagcaagtgaataatcagggagataatttcagataactttttgggttaaaagatcagaaattgcctttttatcatcaggtagttgatatactaaacgataataaatttcaaaagattgttcttgatcaagtggttttagatcaaaaacatcaagtttgtaacgatttcagccataatcagtggcaaaattaattggtaggctcgtgttatttttttggtaaaaatcaaaaaactggctatagtcaatcccagtttttttagtattatcagcattaaaaagctgttttttaagatcaaaatagcttaaatttccattttgatactcatcttttagttgaatatttgtaattaattttgcttgattttgtacttgaagtcgtggatctttgatctttcaattagcaacggtgacaagcggaattgtgattattgcaattccgaaaaaaactgcggccccaattgttaaaagattttttctagaaaggttagtgttttttttttttttttttttgtagtgcaagttggtgttttccataaattttttgatttccttaatttcttcaattaaaatcaatatctcttaaaaagaaagttttatacattaagaattataacatttttttcaaagactaagaaaaaaaaaaaaaaaaaaaaaaacctacaaaaattgtaggttctcaaaaattagagaaaaacctaagaaatttaggtttctaaatatttagaaaaatcaactttctcaagcagtgaaataatttcttccttgctttgggcgtttttaatcttttcaatatttgcaacatcttcaaaagcggcaacaatttgggggagtgctaccgatgtatgaatatctgaattggtagctgccagggtaattaaaatctgaactggacgactatcagcttcaaaataaaatggtttattaaaaacaacaagtgaaaagccattaccaaaaacgccttttccagcttctgcatgaggcatagctaaaaaaggggctaaaatataataaggcccattttcgattgttgattgaattatcgcatgaacatattcagtactaattagacctttatctaataatggttgacaagaaattttgactgcatcttgtcagtttgatgctgtctgatttataagaattgaatcattttccttaagacttgtaagtaaattaactgacatataaaaaaatccttgattttttggctaacttagttctttaagaaccggagttagcgcagattttatctcattttcatccattaaattagttacgccaacaatttttgctttttgtttttgactaaattcgctaacaagatgtttggaggcaataatgatatcaactgaattagtaagacctttggattggcccattgaaagcgcttcaactgtggcatctattcctaattctttgacaattttttgaactttcaacttgataatcattgaagttcccattccatttccacaagcagcaacaatttttaatgccataaatacctcttttaaattatttttaattaaaaataagatttgaaattaaaaaatctgaaatttgaatttagtttaattataccttatttttaaaaaaagttaaataaaaaagagaaaaaaagttataaatcttgcaaggatcaaaaatttttataaaaaaatattattctttataaaaatttttaatttattatcatttaatttcattttttaactttttttaaaaatcagtgtcaaagcaaaaataactaacttttaaaccggaattttaagctttttatgaaatgaaatcagctctaatattaatattaaaaaaagttttgatttttagtaaaatcaaaactttttgtttaaaattcctaattttttccttttttcgaaaaaaatttaaaaaatctttaatattaatgcaccagcaaaatttagacttctttattaattagatccacttcaacttttagtagtttttgtagtcaggttttttttgtttggttagtagaatcaaccgcttgacctaataaaataagaaggagaatcgcaacgatgatcgcaatccatccaacaacaaaatgaaactgtccaataattaaaacaagtccaaagaaaaggtttcaatcacccattcccaaaaatccggttgcaaccggattttggcctaatggaattccttcaccactaatattttgtactaatttaagcgcaaaggaaattattataatttcaaaaaatccaataattgctggaacaataaatgaagcttttcaaccaccagaagcattggcaaaaacacccatagccccagaattgaaaaagagggtaataaataagggaacagcaacaagggaaaaattatttcccgggattgccgcaagtccgattgtaacaaaaacagcaaggaattgaccaaaaaccccacctaaaaatccgtaagttacggcattaattgaaaatccataagttgcggcaatatcaacagcaactaccgctcccggaattattttctcggaaatcccatggaatgactgttgtaattcagtaacaaacattcttaccccggtcattaaggctactaaagttgctacaattttaagtactccacctaaaattaaaaagacaaagttagccccacctaaggaagaatttcaagctgctccaatttctttagctgcagttttagctgcagatgttgcgctttcaggagctgcaaagccgttaaatttcggattaattacattttcaattccgtgatagccaatgataattgcaaaaagtacggcaaataaaactaaaatgataattgtctgggtaaaaatattatcttcaaaaattttaagcgaactaggcaacttacgattttcagcactttgctcttttttcccaaaaaagcgaccgattttataacttgtaaataaactaagcatctgttgatgcccaactgcaaaaccagcattttgggtaactaaattagtaatttttagtgttgctcccgatgcagttgcccaataaattcctaaaaatagccctgaaattagcactagtccaacttgagatccagttgagatagccccatcatcaagaagcgggaatgtccggaataaaattacatataataaagcagttacaattgatgattgctggagcattacatgtcctgtaatcataattgagtttgtatttgtaaatctttttgctaaaaccattaaaatattaataataaaagcaaaaataaaggtaaaggagatcaatgtaagaaaatcattagcagccccaaaacctttttggagaaaattattagcggaagtccaaccaagataaggatctaagggcacaactcccccttctttaattcctccgattgcgttaaaaactggttttgctagcccaacaagtccgccggatccaaccgttaaaaggaaaactccaattgcagtttttagagcgccaagaattgcatcgacttttccacggccaagagcgagataaccaaataatacaagcgatcctaaaagcaaaggattttgccggagatagttatccaaataaactacccgcactaaaaagttaagggcacttgaaaaactttcttgatattttcccattctaaccccgagtgtgatcccgatgattaaaatgttaattaacaagaaaataagcaaaccaaaaagtaattttttattcttatttaaagacatttatatttcctttcgaaaatttagtctaaaaagatcgattaacgtataaaaaccagggttttttaacaaaaatttttgttaaaaaaacgaaattcttctagattttaaaggatttttttaattcaataatataatctggaagaattgatggatcaaattttcttggctgatcaaaggcaagaatttcagctggattattaacaagaatattattaattgtttccttgctaattccaacttgttctaaaagcggaataaaccgatcgaataaataggttagtccaaaagttcatttacctttaagttttccataatttcgctgatataaaacacgaccggcatcaagtgataaggtaatatgtttttctagtcctagatcgacaagatatttaatattttcagcaagagttgtatcaggaaaatacttaacccgatcaggaccatcaaaacataaagataccccaagttctttaattatttttgcataataatatttatcagggtttttattaagatgtgagatctgaattttccgtggatttgcaccaaaatcaattaaatattttgccgcttcataggccattgttcctaattgggtatgaaccaaaatcggtgccccggtttcaattgaggctcttgctgcaacctcaagtgattttaattcaagtcgatcaattgctccatatccagttccggctttaataattcctgctttggcttttgaacgtctaaccacaggacctgaataattatattcatccattccctgtgtaatttcagcaacaaccatttttacaatttcatctgttggtgcaagcgcaagtcatgatgcgcctttatcatagaaagccgctttatgaaatccagttgccataataatatgcacttttccttcaagagctttggcaatctctaacattcgatagacatcccgaccaacatttgggggatccattgtcactattgtttttccaccccgggaagcatattcaagtgattcagcaattgcagcctcatttgataacattacaaaatccggatgttcgtgagcttctggcccataatttttaattaaatgatcatgacagtcaacaacacctaattccgatgggtgaatatcaccgagaacagttcgtgaaaatttgtccattttttaaataaaatttatcctttcgttaattttgaatttaatttgaaaaattttttatttttttgttattttaaacattttaattataacattaaaattattttttataaaaataaaaagcaaaactaattttctagttttgcttgcaaaattaaaaaaaaattaggattttttaagtaaaaattttaattttgttcatcaattaatttcagaatttcctgcccggttttgatctggggattttcaaaccgggttgattcgattagcgaatcaagtatgatattagaaatttttgtagccttaaaatcaccattatcggtaagaatttctgatttttgaccgtttttattatcaagggcttttagcattgactccattgagatgattactgaacgcagatttgctgctttttcgtataaatttcagtcaatttttttggcatcttcgccgattagttcaaaactttttttattttttttctcaaaatctttaattgtggtataatattgattatattttgctttgatttcatcaagtttttctttggtgaccatcgtttttaacgggataaaataacccgtatttttcattaagtagtcggcattatcaattaatttcccgtcaatatcgttttttcctgtatataatcaggttaaaaatttctgcgttcccttatcaattttttcatttccagtttttataggaattaaagatgaaccgcctgaataataaattgaaacgggggagtcaggtagagcttttaaaggctgatttgtatggaaaatgtcattaaaagttgcaaattttttagccttttcgggcatatttttggcaaataagtttcttgaggttgctgaatccattgattgcttgattccaactccgggaatataaccaaaaaccgtgcgatattgtaaaagatcatgacttcctcactggccaattcccggcgctttaaaatttttaaactggaaagcttgaaggatttttgtctgatttttgacttttttggtcaattttttattacttttaacgtatttatcataggtttttataaattcttggcgcaaatttggatctgaattaattaaaaagtctaaatttttaccttttggactccagaaaggactacctgtttttgagatcagatccttatggaaaattatctgggaataatcaaggtcaaaaattgtagcattctcagttgcctcatcaagttgggcatcttctctaaatttgactccgttaataaatttagtggcaaattcaagagcattttcaatattttcaaaagtcgaaagatcaacttttaggtccttaaaaacatctggggctataatatcaattgccctgaataaactgttttttggggtagaattcccattattttcagcttcaactgctttttgatagagctcacttgatttatcaatactacctccgcctttttcgattagatcaaaaattatttttagattatcaaggttaaaaccaagagcatcaacatcatttttattaaaagggatattataaaacttattctgaccaaaatcagaactattataggcgctaacaagtttatcaacaaataaatcagggcctaatttttcgttcttgatttccaaaagtcggttatgttttgctaaaactgaggcagttgaaagatcgccaagaacaaggctaggaatctgatcggagtttgaatcaagtaaatttttgatattctgggtgagctgggactgtgtttttgcatttgattcattatcaagcacaagccgaactgggacaaaatcaggatcgtctttaaacgtcttattataataaggaattagtcctttttcattttttccatattcattgagcccaaaaattaaaggccaaaaaacaccctgacttgtgtttagtactacttgttctttctgactaccgcacccagcggcaattaggaaaaatgagggagataaaatagggaataattttaaatattttttgaaattcataagatttctcgctttttaatttttgtgaaattttttataaaaaaataagaaaaatttttattgttcttttaaaattttttgaatataataaattataaattagaaatgcaaaaattttgcaaaaaaaaggtaaaattttcattatggaaagtcaaaacagtgcgattaagattaaaaatttaattttctcttatgataaaaaagagtttttagaaatcaataatcttgagattccagctaaaaaaattactacaattttagggccttcagggtcaggaaaatcgacttttttaaatttattagcgggatttttaccttcaaaagcagcaattgaatatagcccggaatttgaacattttggctatataatgcagaaaaacaatctttatgaagaaataagtgttaaaaaaaacctatggattagtacaaagaactctttaaaatgaaggaaaaaagtctgattattaagtcttagggaatttgccaaaatcaaaaatttacctgattttggcaagaatttaacaaatttttttatagaaaaatcagattcattttgaaaaaaaattgcacaaaaagtaaatttttatatttttatcataaaaaatgtaaaattttattatttttatattaaattttgcaaaaaacaatttgaaattgaaattaaaaaaattttaaaaattctggaaattgaagatatttttgaaaaaaaagccgcaaaaatcagcggcggccaggaacaaagggtcgcttttgccaagtcaattataaaaggtgataatatggttttaatggatgaacctttttcctcccttgatacaaaaataaaagaggcaactatcaaattattacttaaaatcaaggatgaatttaaaatgacaatcattttagtaactcatgatcaaaatgatgcaatgaagattagtgataaaattatccttttaaataaaggcaaaattattcaattttcagtacctgaagaactttttgaaaatcctaattcattatttgctgcaaaatttatcggctctcccgagattaattttcttgaaaaaaccgcggaaaaaaatttttatataagaggaaaatatgttaaaattttgccatgcataactaaatcaaacggcaaaattttatataaaaaaaatcttgctgaaaattttttctaccaaatttatgatattgaaaaaaatactaatcttgaaattgtaactccgattgatattactgatcaaaaagttcaaattgagtatgatcaaagcaaaattcttgcctttgataaagagggtaatcgtgttcgggattaaaaaaaatactataaaaaccgttgtttttaacaaaaatacgcaggcaattttactaattagccctcttgtaatctttcttttaattttttctgtctatcctatttttcagtcattttttaatgctttcaaggttgaaaataatacaaattggcggcttggatttagtaatttttctagccttttttccaagtcagctttcagggacgctctaaaaaacagcacaattttattttttttaagttcgccaattgcgcttttttgtggatttgtaatcgcaattttgcttacaaaacttaaaaacaaaattgtgcgcagttttcttattagcggattttattcacaatttttcatctctgcttttgcaattggaattgcttttagtttcctttttggtgaaaaaaatgttttttctaaaattttaggccttaatttttcttttgttggcgaccaaaatcgtattagtttgatttgactttatctaatttttcaattatgaagggcgattccgtttaattcagttttgttttttttcgctttttcaacaattaatgcaaaatatgaaaaaaatttcaaaattgataaaattagcctaaaagataaaatttttaacctttattttaaagaaattagtacccaatttatggttatcgcctacacaaactttgtttttgcaacgatgttatacccgaatgtaataacggcaaatttgaacttggatctcaaccacgggcatacgctggcttcttatattttgaatgtgcgtgatgatttaggacttcaggcagcagcaagttttgtgagttttctataccttttagcaattttttctacttttttaatttttcggccaaaaatctgaaaaataatttataaaaaaataaaaacaaaaattaaaagaaaggttgaaaatgcacttaaaaattaattttaaaaactcttttattcaactttttcttatgtttttgttaatttttttattaatgatttttctatttccgctatattatttaattttaaatgcaagtttacctgatgaattacaggataatccgaatctttcattaaaattagatagctatttatgaactaattttcaaaattcaattaacgaaaatttctgaaaagcgctaaaaacttcaatttttgtaattttattaattaattttattagaattttactttattcacttgctagttttgggctttgaatggctaataaaaaaattaaattagtatttattagtctatttattgtaatttcttttattcccgaaattagcatttatatcccgctatcaaaaattcttaatgtcaattatctagttacaaatgcgccggttttttcgttaattactaaccaatttttttccttctttaactttttttacctatatagatcgattaaaaaaatagagaaaaaacaattttttctagcaaaaattgataaactttcaatttttgcaaagtttaaattaataattttcccaaaaattaaaatttcttattatttattaattattttcacaacaattcaagcctgaaatgattttctctggccaaattatattttttcaaaccgatcttttcagacaatttcgacatgatttcattattctggccaatcaagtttgggatttctgcaaaatattcaggctgcaggatcgctttttgcaatcctagtacctttatttttttatttaatttttgcaaaatttataaacaaagcgactgctaataatataaaataaactctagaaatgaaaaaaattatcacaaaaaatgcaacttttgaattcgaaatcaaaaaatcgaaatttatctcgctaagctttctacttaagcataagaaaaattttgaatttttacttaattctgtcaaaaatgagcataaaaacgctactcatatcgtgtatgcggtttgttttagtttggaaaattgtaaatttagtgatgcaaatgaaccgaaaggttcagccggaagacaaattttccagattttacagcgaaaaaaactaataaattcactaattatggtcatacgttatttaaatggtggcaaattagggcttggcctgctacaaaattcctacaaaaaggcggctcaagaagtaataaaattaagtaaaattgcagattttacctccttttatagctataaaattaatactaaaattaaaaattttaattttattttacaattaatcaagaaaaataattgtaaaataatcaaaaaacagttttcagaaacagttgaaattgaatttgaatgccaaaccaaattagataaaacctttggttttgattttttcgagataaaaaaataagaaaaatcaaaattttaatacaaaaaaactttcaaaaaacgtttttttgtattaaaatttaaggtaaattaaaaaaatagactaaaaactagcgatattaagagaaaaaatgattcaaattcgtaatgttacaaaaaaactaggcacaaaaataattcttgataatatcagtgttgatattccagctaataaattaacatttatttcgggccagtcgggggttggaaaaacaacgcttttgcatattatcgcgaggattgcctatgctgatagtggtcaaatttctttttttgataatgaacagaaactaataaaaaacccaaatgttgatattgtttttcaagattttaacctaattgataatatatcggcagttgataatgttaaaatcggcactaatattttaggttatagtttcaaacaagatgaatttgtcaaaaatgcaaattttttaaatttggattcaagtgtttttaaaactaaaatggaggatttatccggtggtgaaaaacaacggatttcaattcttcgatccctaaatcgtggatctgaatttatcctatttgatgaaccaacagcatcacttgataaggaaaatgagcaaattatttttgaaaaaattaaacaaatgtcgagaaatcatacaattgtggtaattagccataatattgaaatggtaaaaaaatatgctgaccaaattatttatttggataaaaatggtccaccaattactgaaattattgaaaataattctgatagagaacttgaaaataatgagattccaccaccaaaagtaaaaaaaatttcaaaaatttttcaaattaagaataaactacgaatttctccaatttttgtgattgctgatattagcaaaaaaataaccttaaccatattaattataattgcatttttagcagcaattttctcaattagttttgcttttcagttaaatcttggtactgaaaaagttagtcggcaacaaaaatataccctcgcacttgataaaaatttattagaaaaaaagtcaaaaactacctttaatttagatgaaattaaccaaatcgagcattttgagtcagtaaattcggtagttccaatttattcgattgccgatttaagtttttactatgaaaaccgaaaaacaggttttgattcaatcgagcaagtcaaaattaataaattttttaagaacagaatcgaaaatgatattgttaattttgagggaaaatttattgaaaatgctaatgaaattatcctttcaaatgcaacagctgaaaaattaaaaatcaaaaatccaatcggaaaaacaatttatttagcccagggaaaagttacagaaattgcagctgcaaaaaacaaaatggccctaaaaattgttggaattaatcacggaattaaaacctcggtaggcaaacttaatacaagctttaatcttattagttttccaacttttattgcaacagaaacaatcttagcactagaaaatttagtaattcagaataacaatttgcaaaaaaagctagaaaaacaacaacttttttcccaaattagttcttattaccctaatgaaaatcagcagaattccgcactcgtcccgtttaaaattcagttaaaaagtactaatgcacaaccagaaaatttaaaattaatcaccggaagaatagcaaaaaaagtcgatgaaatactaatatctacaagcgcggttgatttaaatgcaaaatataaattaaaagttggtgatgtaattgaatcaatttcaccccttgatcaaaaagttaatcttgttgttgttgggatttttgaatcaaaaatctcggaactatactatcataatcaagccaaagaattttataaccattatcaaccagaacaattagcggcttatcttgtcaaaacagaggaaaataacgggcttgatggtgaggctaaaagcgctaaattcgacctaaaaattattccaccctcaaatttgatcagagtaataacaagtcaatcacttgaaatcatcgcgattattaacaaggtaacttttgctgtttttatcatttttgtcatcattttaattgcttttattcttgtttatgcaaaaacaatttctgaatcaaaacagaaaatgattggaattctaaaggcgctcggcggctcaaccctgcttacacttttttatcacacacttaatattctgctaatttcgcttgttgttcttggtcttagttttttagtgatttttccatcgatggaatcaattcatacattagttgttggtaatgaattacctccagcttcaaaatatcatttatcactaattttactttcatcatgagctgggctttcaactgtttttatcctaatttatgttttaatgtcactgataacttataaaaaaacaacacaacaattgctacgctaaaataaaaaaatacttaaattcaaagtattttttttattttagaatctaatttaggaacttgtatcaatctattttaaaaattgtaaaaaaaattaactaactaattaattttgaattctttaaatgaccttcaagaacttctgtggtaacataaccctcaaaacggcgaacttgttttccgtttttataaaataaggatgtcggggttccttgaactaaattttcacgggcaaaattaggattttcgcggacattcatccgaattattactaagttttggttatcaaatttcttatttacttcatcaattgtattttcatataaaatgcatgcgccacaatttggttgatggaaaacgataactacatttggcgatgtgagaattttgttgttaatatcctcagttgagtggatgtcaaaaattggcatatttctccttttctatttaattttactacattttttgaatttttagaaaaaaatttaattaaaaatttagtaagattttgcaaacaaaacaaatttatttgttttttcgccactaaaaattgaatttcctgtctgtggtaaggcaaaaaatgaatttttgggaaggatgcagcgggcagtagctccggttttttcctgaatttcttgctctctttcgggagattcactaaaaggggcaattacaaatttattattttttattgcctgttcgaattcattaatagaatttacaaaaactgtattttcaagaagtcgaatttttgcttttttgaataaatcagcttgaatttgttcaagaattttacggcatttttcttttaacagatcaatattgaaaaaaaatttttggtggttatcacgtcgaactaagcaaatttgattatttttgacctcattagggccaatttcaatccgaattggtgcgccgtgaacctctgaattattaattttgtatccgatttgttgatccgtgtcatcaattttataagaaattttagcgttttttaaaatttttgcgattttctttgcaaaaattttaacttcttgattttttttagaaaaaaattcaagaatatcaacctgaattggagcaattttaggtgggaaaataagtccgttatcatcgctatgaaccattacaattgccccgattaggcgtgttgaaagtcctcaagaggtttggaaagggatttgacttttattttctttatttttatagaaaatttcaaaattttttgcaaaattttgacctaaaaagtgagcagtagcagattgtagggcgcgaaaattttgcatcattgcttcaactgtataagtatttacagcgccagcaaacttttcacgctcagttttttggcctgaaataaccggaatggccaaataattttctaaaaaatacttgtaaaatcgggctatttttttagcaaattggtcagcttcgaccttacttgcatggattgtgtgaccttcttgtcataaaaattctgtatttcgcaaaaacgggttagtagttttttctcagcgtaaaacttgacttcactggtttaatttaattggcaaaatgttattttttgcaatttctgccttaaaataatctgcaaaaagaagctcgcttgttggtcttatataaatattttcgactaaatttttacccccaactttggtaatggttagtaattcaggagcaaaaccttcaatgtgctttttttctttttcaataaaatcctgtggaattaacagagggaaataaacattttcaattttttgcttaacaaaataagcattaacaatttttacgatattttcccaaattttataacctaaaggtttaaaataaattgttcccttaattgggccataattcattaaatctgcctgagtaataacatctacatatcattttgcaaaattggctgttcttgatgttattttctcaggttttttcataaacttgtttttttataactttttgggtgtggtgaattaacatatggctgccccagttagattcgaactaacgaatgacggtaccaaaaaccgttgccttaccgcttggctatggggcaaaaatggtggggggtgagggattcgaacccccgaatccgaagaaagtgggttacagccacccgcatttggccgctctgcaaacccccccttaattagcgaatgcaaagtaattataacacatttttttaaattctcatttttttttttttttttttttcatttattactttttaaattaaacttttaacttaaaatttgactttggttttcttatttccttaatttaattttaaaaaaaggaaaaccaaagtaaaattagctaaatatattagcaaattatattataatttttatatttttatgataaaaatcatattaataaaggaaattttcaatgacagatccaaaaatcccgaatttattagaaatatacaaacaaaaattagatgaaatttcatcaaaagagctaaattcagaccaaaaaaatttagcaattcaaattttagaaaaatttgaaccaagtaaacttgaatatgtttttcagtttatttctcaacgaattaaaaccggttttcgctttgattctgcccctgaaagtgatacaaatactgttgctattttagaaaaagatgaaaatcttagttttaaattcaatgaaaataatcaaaatccaaataccttaattattggtgaaaattatgatggattaaaaaatttattagtaatcgagagagagggggagagggagagggagagggagaggaggctttgatataatctatatcgatccgccttataataccgaggcaagtaaaaatgatgggaattcaattgctaatgaaaaagaagatataaaagcaagtaaatttatctatcgtgataaattttcgcgtaatggttgactaaatttaatgaatgaacgactaaggctagcaaaggatcttctaaaagaagatggagttatatttgtttcaatagatgacaatgaacaagcttatttaaaagttttaatggatgaaatttttggggaagaaaatttcgttgctaatatcgtttgaaggaaatcatcaattggttctcataaagatataaaagatatcaaaactgtcaatgttgtaaatgaatacatagtaacctatgctaaaaagaaaactaaattaagatttgattatgtaagacattctcaagaaaagttagacaaagaatataagcttaaagatgataattttgaacaatatggttattatagattagaaagactagcatataaaggattggattatcaagcttctctagattatgagttagaagctcctgatggaactaaatttagaatttatcaaaatattaaaaaaccacaaacaatgtgttatatatgatccaaagaactatttgactatgcgaattctttaaatttagtagaaatcaaaaaaactcaacaaggcaactgagttgcttataaaaaagtttatcaatatgctaaattcgatgcaagaactaaacaatttatcttagttgaaaaaggcgttccttttactaatatgattattgctaatcaaaacaatctacatttgaatattttgactgaacaaggttctaaagaaatgacaagcattttcaaagataaaatgtttgactatccaaaaccagttgaattagtaaagtatttaattaaaatggcatctagcaaaaaagacattagaatccttgatttctttgctggttctggaactactgcacaagccgttttagaactcaacaaagaagatggtggaagacgttcttttgttttagtaactaataatgaaaataatattggtcaaaacgtgacatatgaaagactttatagaattaataaaggacaaggcacaaaaggtcaaaaagactttgaatgaatcaagaaaaatgaagcctttgatacaaatttaaatgtattttgatctaaaacttacaatacctctttgttaaataacgatataacaaatcaagaattaaaagataaatttaaaaaactattaaaagaatttggaatccataaaaataaatcaaaagttaaagattctgtattaaaaactctttcttctttaagaccatataaagaagaaaattaaaaaaaataatttatttgctacaatctttataaattatttataaggagaaaaaatgaacaaaaaaaaagaacttttgaaagatcatttaaaggagttagaacaaatttctaaatcatctttaaatgaaaatcaaaaagaattaattaaattaaacttagaaattttaaaaaataatgacaaaatttctatagatgactttgaacaaatttgaagatttttaaaacaaagagtagcaactggttttgtttttgatgaagctccagaaattaataatcaaagcatcgcaatacttgaaaaagatgaaaaattatctttttcttcttcaaaaatgaaggataatttacaaaattctttaatcattggagaaaattatgatgttttaaagaaccttataggagtagagagagagagagagagagaggattctaacttcgatttaatctacattgaccctccttataatacacaaaagacatcagatgatggaaataatttaactgatgatcaaataactgctgacaagtttatatatcgggataaattttcaagaactggttgactaaatttattaaatgaaagattaaaattagcaagacaacttttaaaagaagatggagttatatttgtttcaatagatgacaatgaacaagcttatttaaaagttttaatggatgaaatttttggggaagaaaattttgttgcgaatatggtttgaaggaagtcagcgcaaggtacacataaagatgttgaagttgataatttaaacactgtaaatgaatacatagtaacatatgctaaagataaatcaaaatttaaatttgattatgtaaaacattcacaagaaaaattggatgaaatatataaatttagagataaaaattttgaaaaatatggtgcatataaattgcaaccacttgttaatagttgaaacggtgcctgatacagatctggacaagattatgaattagaagctcctgatggtactaattttaaaatatgacaaaatatcgataagccacaaagtgcatcttattcttgatctaaacctacctttgataaagctaaaaatttgggtttaattgaattcaagaaaaataaacaagattattgagtagttcataaaaaagaatatcaatatgctaaatttgatacaaaagaaggtgttttaaaaactgtagcaagaggtgttccttttacaaatatgattgttgcaaatcaaaataacttagagagtgatatttatacatctgaaggtgctagagaacttaattccatctttaatagtaaagaattcgactatccaaaaccagttagattaataaaatatttaataaaaatgttatctagcaaaaaaaacattagagtcctcgatttctttgccggttcaggaacaacgggacaagcagttttagaacttaacaaagaagataacggaactagaacatttacattagtaactaataacgaaaataatattggtcaaaacgtgacatatgaaagactttatagaattaataaaggacaaggcacaaaaggtcaaaaagactttgaatgaatcaagaaaaatgaagcctttgatacaagtttaaatgtattttgatctaaaacttacaacacatctttgttaaataacgatataacaaatcaagaattaaaagataaatttaaaaaactattaaaagaatttggaatctataaaaataaatcaaaagttaatgattcagtattaaaaactctttcttctttaagatcatataaagaagaaaatgaagaaaaataaagtaaaaaaggaaaataatggaacttagtgaaaaacaatctcaagctgttgatttattagttgctaaatgagataatgcctttaataatcaacaaaaagcctctgttacttttaaagcaccaacaggttcaggcaaaacatttattattgcaaactttattgataggataatggaagaatttgataaaaactcagctaaaaaactggtttttatttacaatacaatttctaatgctgaattacctaaacaaactttagataaatttgaacaatataaattttatttaaattcaatgaaaaatgcaaccataaaatataaagaatccccttcaaaacaaaaagaagctaaaggcgatcaagaatataatattttagctaaagaagctgatgttttcatttttggaacttcttcatttggcaagtcaactatctttgtaaaagaaggaaaattagatgcttttattgatgaattaagatcagattactatgttatttacattagagatgaagcacatattggtacatcaaaaataagtgaaaaagcagatgcaaaatcatttgataaaaaaataaaagaactagacaacgtttttgaattaatgatgacagctacacccaaagaaaatgatgatatcgttgaaataacaaataaagatttagatgaagacaactgaaaacttctaaaagctaacaaaaaaattaatttaagcatccctcatgaatctacagatgaaatagataattcatttctattagaacaagcttgtaaaactttttctaatattaaaaaacaatacaaacaaattagtgatgatgaaaatttaagaaatttatgaaaagtaaatcctgcaatgcttattcaagtaaaagataaaattcttgaaaaagaagctgaatttaataaagaaataaagcaaattattaaagttttggaaaaatataatttaagttatgctaaatatttttcagaagaaaaaacaaaaaccgttgctggtcacacttcaaaaacagacttaaattctttgtctaaaaaagatagtgatgttgatgtaataatttttaaagttggacctgcaactggttgagatattcctagagcttgtatgttagttcagttaagaaatgtttcttcagaaacgcttgataaacaaacacttggaagaattaagcgttttcctattccaataaaaatttacaatgaagatcacagaaaagaattaaataattcaatagctaatgagttttttgtttattcaaacagtaaaaagtttgatcaaaatttaggtgaaagaatctattatttaaaagatcaatacaaaaacaaaaaatttgttgttggagaaattgataaatctagcataattaaaataaatcaaacttacaaagaaaaagtttatgaattagtgtctaatgaatttgaacaaatttgtgaaaaattcgagaagtttaggaagaaaaatcaagactttttaaggattactagaaaaaataatatcaatgaaggaagatttattgaaaaactaattttcgatcaaattgagcttgaaattttcaatgaatcattgataaaaaaacacaacaatctaataactaacgatatgtgggacaatattgaattaatttataatcagaaaattaatgaaaatattagaatttcaattaattattataaatattacatcttgactgaattactagatgatattaaagaactaaatgtaaaaaattgagaaaatactaatcctaatttaaatatcaaacacattattgctccaccagaagaatatattgaagaatatgaaataattgatattaatgattcaaaagattctttaaaaaattatatagaaataaaaagtgaaatcgaaaaatatgcctattcaaataataaaaaaatagaaaaaaatcaagtaaaaatttctgtagattcaaaaccagaaagagattttgttgctttttttactagttgattagaagatgatgctgatgaaaatttggaaattaatatttgatttagaaattttaaaaataattcaaaaagtatattttgagattactttgaacaaacacaagtaaaaaaatcttatcctgattttattgtttgcatcaatcaacaccaaattaatatagaaattaaaggtaaaggtaataacgacataagccctgaaaaaacaaaagatttaattcaaatgacacaaaaatacgtaaaaaaagcaaaagaaaattctttaaaaaataagcaaaaaaataacttgaattttacttcattaatttgttgacctaaaaatgaaagagctgataatttcttatgtaaaggtgcttcaacattagaaaaaataaatgatttatttagaccacaatcttatttaataaccgaaagaaaagatgcacaagaatatgacattaaagaagaacatcttaaaaagatttttcgaaaattagcaaactaattgctttaaaaaaactacattttgagcagatccgcttttcttagaaaaatagaaaaggggatctgctcaaattaatagtatttttatttttataatctacaaattaaatatcacaatagactgaatataataaaataattaactttttgcttggggttatatatatatatatatatatatatatatataatatttaattatgaatttaaatacatattttaatccaataaatttaacagcaaaaaaattaaaagatattataacggcttattgaattacattatttttacccttaattggtgtagtgtttataataatagcggcagtagtagctcataaagccgtcgaatccgcttactatgctgattcattatctgagaaaagctttgcaatttttgctggaacagcaggaattatgattattattggaatcttaattgttgcaggaactggtatagcaaattttgtgattctcattattatgcttgtaagaatttttgctcttaaaaatttattagctccatatcaattcgcacaacaaaaccaaatgattttgtattatttgatgcatataataaattaaaattttcaggtcttatggggatattaattttttttctatcttgaacaatagttattccgattatgtgaataatagggatttttaaagccaaatctgctgctaatgcagttataatacatttaatgaatagtttaaataattaaaatttacacatcattttcaaataaataaaatactattagttttgaggtgataccctcttcttgaaaaaaatttttgagtgttttaattaattataatttgaaatgaatgtttccctaaatttaataggagacattcattttattttgtctttaattcgtttgtgattgtaataataaatataatttgcaattgctttgtaaagttgtttaaaagttaaaaattctttttcgcgaccataaaaacattctctttttaatgtcccaaaaaacaattcaataacgctattatctaaacaatttccttttcgagacatagactgaattattcctttttgttttaatttttctgaaaattgtctatgttgatattgttaaccttgatcactgtgaaaaattaaaccttcaagatttttgtgctttgaaaatgctctttgaagcatttttctaatttgttggttgttagcgcttatagacaaatctcaagcaataacttcgccattaaacatatctaaaattggtgataaatatgctttttccaaatggtccgctaaattcagttacatttgtagttcatttttgatttggtttatttgcaacaaaatttctatttaaaatattgtctgcgattttgccaacagttcctttgtaagatttgtattttcttcttggacaaattgctttgagattgaatttttccattaatctgcgaacttttttaagtccaattttatagcctctattattaaattcagcttttattcttctttttccatatcttgctttattttcttcaaaaataagctttacttggcttataatttcttcatttttcttgtcaaaatcttcttttttgagttcataataaaaagtagatataggagaaaactcttttaatacttgagttaagcgaaggtttttatcagcttttactttattataaattttttttattttttcttgccttggttgatttgagtcaaagatctctaccaaggcttttcacttttttagtgcttcgatttccttttttaaaagtttaatttctttttctaagtttttttctctttttttaaagtggttatttttttcttcaagaagtttgagtttttccaatactgatattgaagaatttaattgatctttactgtcaaaattttttgatacttttgtagatttattattactaatcttagatttcattattggtcttcctttgtttaattctaaaccaataattcccgattctaaatattttttcgttcaaaaagatatttgacttggattaagattattttcaagtgaaattttaacaattggttcattagctaaaaatcttttaacaacacttaatctttcgtctatagtccattctttatttcgtggtttttttcttaagaccttcaactcctaatttgtcataaattttttctcaaaaatttacttgatttaaaaattttttttgacttgtattagcgaaatcaggctttttaatttcaattccttttttgtatttttttacacattctaatttaaattctaatgaatatttcataaaaaatccccttttctatttttctaagaaaaggggatctgctcaaaatataagttatttaatttgtatacatttgaagactttttaaaaacagaaactataaaatagttgttaaaaacgaatattttgttaaaattaatatataacagatatttattgattcctatgtgggttttaagcgtaatattaagtgcgccaacttatctggctcctttatttgaaggagtttttttatattacttttgcttgctttttttttgtttaatttagatatggaaaaacaagttcaaaaaatatttatttatttagatgaatcttctagaatcgacttgtcatctagtaaacttcgtaataatgtatttaattttggtggattttattgtttaaatgaagaaaattgtaaaaacattttaaataaagcaacttctaaagaaatttggataaaaacaaagcaagaaggtaaagaaattaaaggtaaatctttacatttaaaaataaaaaaagaattaattacttttaaacatgcaataggaattgttgcatttttaaaaattttagacaagaagttttttaactcaagcgataaaaattattttaaattttatatgataagttatttaataaatagcattatagtaaaattaaaatatgaattacgacatcctattcaaatacatttatatttggatcgaaatacagaagttgaaaaagaagatacttgaaaagaaagtttaaaatctcaaatttgaaaaggattgaaatctaaaatagattatttgactgatgaagtgaaaaaactatatactcttgattatgaacctgatatttttattgaaagtatagattcaaaaatggatgacaacatccaattagcagatgttattgcaaatacattatatcaaacttataatgacttgaatctttcatgaatggatttttgttatactaatttttttaatattaaatttattggcgataaaccaagggtaccaaaacttatgaattttcaaaaacttattcataatcagttatttgaagaattttgaaattgtattgagtatttagataacaaaaaagagtagactcctgagatgataccctcttcttgaaaaaaatttttgagtgttttaattaattataatttgaaatgaatgtttccctaaatttaataggagacattcattttattttgtctttaattcgtttgtgattgtaataataaatataatttgcaattgctttgtaaagttgtttaaaagttaaaaattctttttcgcgaccataaaaacattctctttttaatgtcccaaaaaacaattcaataacgctattatctaaacaatttccttttcgagacatagactgaattattcctttttgttttaatttttctgaaaattgtctatgttgatattgttaaccttgatcactgtgaaaaattaaaccttcaagatttttgtgctttgaaaatgctctttgaagcatttttctaatttgttggttgttagcgcttgtagacaaatctcaagcaataacttcgccattaaacatatctaaaattggtgataaatatgctttttccaaatggtccgctaaattcagttacatttgtagttcatttttgatttggtttatttgcaacaaaatttctatttaaaatattgtctgcgattttgccaacagttcctttgtaagatttgtattttcttctagaacaaattgctttgagattgaatttttccattaatctgcgaacttttttaagtccaattttatagcctctattattaagttcagcttttattcttctttttccatatctagctttattttcttcaaaaataagctttacttggcttataatttcttcatttttcttgtcaaaatcttcttttttgagttcataataaaaagtagatataggaatagaaaactcttttaatacttgagttaagcgaaggtttttatcagcttttactctattataaattttttttattttttcttgccttggttgatttgagtcaaagatctttaccaatggcttttcacttttttagtacttcattttccttttttaaaagtttaagttcttctctaagaagtttaagttcttcatatacagataatgaagaatttgattgatcttgactgtcggaattgtttgatacttttgtagatttattattactaatcttagatttcattatcgatctccctctgtttaattctaaaccactaattcccgattctaaatattttttcgttcaaaaagatattagacttggattaagattattttgaagtgaaattttaacaattggttcattagctaaaaatcttttaacaacacttaatctttcgtctatagtccattctttatttcgtggtttttttcttaagaccttcaactcctaatttgtcataaattttttctcaaaaatttacttgatttaaaaattttttttgacttgtattagcaaaatcaggctttttaatttcaattccttttttgtatttttttacacattctaatttaaattctaatgaatatttcataaaaaatcccttttcttaaaaaaagaaaaggggatcacctcatttttgaaggattttttttattaaaacttacgatttgcagttgtatttaatcagttgtaaatacttaataatacttttaaaaattaaataatttttttatattttccctaaatctttcattactttttctatatcagtttcttgaaataatgtaatttgctcttcttttttaatggcaataacactgatttgagctcctttgttattttcgattctaggaattaaattattgctattgctatttacaaaatataattttttagatttttcaaaatctaaatatcactgacccatattagaagaataaaggttaaaaaagcttaaattaagtttttctactgctaaatataaattatattttgacaatatattttcaatgctttgattttcaaagaatttatttatatatttttctaatactggctttaagacattagaatctagtttattaaatttatttacatttgttaatgtaaaagttttaaatttattctgagcaaaaaaattatcaaatttttgttcattttcttttattgaattgttgtttatagttgaatcagcaacaaattcttttacatttgaatttaatttatcactactttttaaagtgtctttaaaaattcaatatgaattcataaaatattttttttgatattctgcaaagttgtcttcgctttttttaagaaagaaattattaaaataattttttaaaaatgattgttgataagttttggtttttaataaatttaaatctattttatatttttgctcttgcggaatacgatttcacaagaataaagctacactactcatcgaaattgtaaatattatcaaataagatcataaaactaacagtgagattttgataggttttgttattttagttcttttttcttggctaatatcattagcaaatcaagaaaactttaattttcatttgtttttttgtctcaaggtagccccttccattcttgtaaaagagtttttcaatctgtttcattattaaaggcaatattgtcttcttttttaaaggctattatacttatagttgcaccattattggtatcgcttgattcttgcggtcatggataataatttacaaaatataattttttatctttaagaaaatctagattccatcaacccattctagaagagcttaatgtgaaattcgagaaagagctattctttacaaaataatataagttatatgtttgtagtacttgctctacactttgattaggaaaaaattttgttaaatatttttcaaatacaggttttacaatgttcgaatctaaattatcaaactctgtttttaaagttaatgtacgagggatttctttatttttgttaaaaaaatctgaatatttatctatgttttcttgaattttatttttttcttcatctgtattggattctgttttttggatgtgagaatcaagttggtcactactttctaaagtatcttgattaactcaataagtactcatgaaatattctttttgatatttattaaaattattttgaatttttttaaatataaattcattaaatgaattttttaaatagattaactgtttttcttcttcatctgatagattaacatagttgggttgatcaagtttataatataaacttaaataataaatggaaacagcagatatagaaacagaaataattgttgataaaagtaataaaattttcttcgttttagacatattttaatcctttcttacagtgtacaaattttttaatttattgaaaaaatatatttaaattagcattttccttcatttttgaagcaaattagtaaatctagaattgtaatatttcaaacaaattgacttactactaaatttattttttaaatttttaattctagctaatttagaaaatacgaaattatatttaaatcaatttcataatggtatctatgttgctactttcaaaaaattctatattttcagattttttaaaagcaacaatattaatttgtgcgcctgtatatggaaccatagtatgaactatgggacgttgtggaggctctataaaatatagcttattgaattttaatgaatcaaatcatcatcaacctaaatctgtttttgaaagaccaaatgaatatatttcactttcttttacaaaataatataaattatattgatcaaaaatttgttctatattttgattaggaaaaaatttacttaaataatttttaaaaataggttttaaaatatttgaatctaaattttcaaattcttctttggtttttagtgtgtaattagtagctttatttgttttaaaataattatcaaatttttgttgattttcatttcgaattctttgttcattttcacttaaatttgatttaaagtaaaattcggatggaaatggttgctcaactttgtctaaatatttcagtgtttctctatgaagtcaatatgaattcataaaatattttctttgatattcttcaaaattatcattaattttttttactacattattatcaaaaaaattatctttttcttggtttaaaaactctttatttttgcatgctaaagtaaacaatcctattgttggaattaagacaacacttgataaaattttgcgaatttgtaaagatattttcctctttttattcatattagttttccttaaatacagtatgtgtcactgcaatagaatcatctactgaattttcaaataaagaacttttgtattttttaactatatatctataaattccagaatcttgaactttaaatttaattaattctacattactgttgatacttaatgatgaacttacactttgtcaatatcctctactatctaatttttctaatactaaatcatagtcagtgaataaagcttgattttgacgttttttagtttcttcaagtttcaatctattttcgtttatatgtttactttttcaatcgcttagttttagttcataatcaattccctgagcagtttgttttgcaagtgctcatgttggaaataatcattctcatcaatttggatgttgtaattctggtttattctcgttttcttttagcaatcctgagttaaacattcaactaagtgctatatttatttgttctccagcttgtaaatttaaatgtgagctttcaaatataccgccatccacatcggatttaataacagatttagtattaatatttcagctgcttcttgcattttttcaacatctattaaacctgctccataagttgaatcaaaaccatttccttttttatttaaatttttgtatttaggtaaatgtgcagaggcagctagaatagacattgcagatggtactctaaattgatcattatttaatcaagaaaatttatcaaaaatatatgaaatagcaccagtaactacaggagcagcaaaactagtacctctgatttcatcattattctctaagagtatctcccctggtgcaacaactaaaggtttaggtaagtttaaatggttagactctagttctctgttagaaaagttcgaaatttcaatgtcatttaaaaaagagttttctctatattttgttgatccgacagaaattgcgttatatgctaattgagtgctgtcatttcccttttttattttgtttgttatgaccatttccagcagcgaaaacattaactacaccatattttcttgaaatataatctatgaaaaaactatcatcatcataagggagagagtaatcagcagttggtccatagctatggttaataaactttacattattttttaaaaccaatcattcaagagcgttttgtcaattaaagttattagaactaaaacttgtgaaataaatttgtccatttgaatttattccgtttttacctgctgcaaccattgatacattagtcccatgtgtatcatttaaattttctggagtaaataatttaacttcaggtgtatgtacaaatttataatttctttgtaattgagttgtacctacttctaaaattcctatttttgaaccttttctgtgatatttaaaaaattctgtttgcttttcaggatttaaatttatttcttttaaaagtagttttttattaatgtctgaaaatctagaaatataatagccattctgttcattttgggaaactacatcattatttttgataataacttttttataaaaaacaattctttttacaaaatctaatgtatcaacatatttgataaattctttagatttttctacatcattaaagtaaaatcaaacaataggtagcattgcactagtttgaatttttcaatttatgtttttgtttttaaagcctctttttattttatttagaagagaatctattctttcatctaaatttcctttttcattaaaaacatctaaatatagttttaattcaattgtatcagataccttgtctgataatttttttccatcagtagatttggaagttggaattttccaatcattaacaacaaattttttacttgcaaaatttattgttgctaatttttcattattaattaagtttttattttgattaaatgaaaaaataggtacaaaaactaacgaagttattgtacctatcgcaaatgaaaattgaaaaaatttttttactttaagcatataattctccaatttttgaatttttattaagaaaaaaaatatataaagaaaattaaattttgaaataaatattcaaattattttaaaccaaatgtatatggattttttccttattttgtcttcttttttagatttgtttatgttatttttttaatttttgttttgattatatcatttttttaaaatatttaattaaatttaaaaaaataaataagataaataatttttaagtgttattattctttgaatttagattagtaaagttttttcataaaaaataaaatcacacatttttttaaaaatttagcaaaaaaatttagtttttttttttttttttttttttttttttttagctttatcaaatttaacttttaaattcaaattaaacaaatatattaatagttaatttaataaaatatattataatgtttaaaataaaaattgtatttacaaaggaaattttcaatgacagattcaaaaatcccaaatttattagaaatctacaaacaaaaattagatgaaatttcatcaaaagaactaaattctgaccaaaaaaaattagcctatgaaattcttgaaaaattcccggataataaacttgaatatgtttttcagtttatttctcaacgaattaaaaccggttttcgctttgattctgcccctgaaagtgatacaaatactgttgctattttagaaaaagatgaaaatcttagttttaaattcaatgaaaataatcaaaatccaaataccttaattattggtgaaaattatgatggattaaaaaatttattagtaatcgagagagagagagagagagagagagagagagagagagagagagagaggcggctttgatataatttatatcgatccgccttataatactgaggcaactaaaaatgatgggaattcaattgctaatgaaaaagatgatataaaagcaagtaaatttatttatcgtgataaattttcgcgtaatggttgactaaatttaatgaatgaaagattaaaattagcaaaggaccttctaaaagatgatggaataatttttgtttcaatcgatgatgccgaacaggcttatttaaaagttttaatggatgaaattttcggggaagaaaattttgttgctaattttccatttatttcaaatttatcaggtcgccaagtaaatacaaatttggccctttgccatgaatatttattgctctataaaaaaaataatttcatatttaataaaattgataaagattatgccaataactttatgcctattgtttatcccgagagatctaatgtgattttcaatgaagaccctgatgtaaataaggaaatttatgataatagcccagaacaaaaagaagataactccactcaatacattttgagagataatttagaaaattcaaatggtgagtttaaccctaaaactcgtcctaatttatttttcccaatttacgcgcggaaaattaatgagaaaaataaattatgagatattacggtggaagagcctgattcaaaacatgattttattgaaatttgacctcgtaaaaatagcaaaaatattcaattagtttggcgttgaggtaagaagaaaataatgaaccaaattaatgatcttgttattgtggagccaagggataaaaatgataaaaattatagaataaaagtaaaaatatttgatcaatcctacaccgttaaatcatttattttaggtaaaaaattcaataataagtccgctactaaagaattaaacaagatatttagcgaatcttcggaaaaggttttcaattttcctaaacccactgcgttaatagaatatctaattaatttacaccccaataaaaatgcaagagttcttgatttttttgccggaagtgggacaactggtcaggcagttttagaactaaatttccaagatggaggcactcgcagttttactctgataactaataatcaaaataaaattgccgaaaatgtaacttatgaaagactttttcgaataaatcacggttttggaacaaaaaaagagcaaaattttgactggattaagaaaaatcaaccttataaaactaatttagatgtttttcgaattaattattttaatacagaaatttttaacaaggaaaatgatgttaatttattagttaaaaaactagaaaaaatgttaactaattttggaatttctagcaaaaataagataaatctaattgaatatcttaactatctccttgcgcttttgcctcaaaaaaaggataaaaaataatgtatttagatagatgtccaaaaaaacgttgttaaaaaattatttaaaaaagcgcgtaattctcttagtaaagaaaaaaagaagcaatttattttaaagccccaactggttctggaaaaacttttatgatgatcaatttcattgattatttaattacttgaagtaaatctcaagataagcttaaacttgtttttgttattgctaccttatcaagtgctaatctccctgggcaaatccaggaaagttttctaaaatataaaaattatattaataataaaaatctaaaaattcatcgtatttaaagtccttcaaatcaaagacaagtacaaaaatcgaaaaaaattataaattttatgcagaagtccataatgtttatattatcggctcggcttcatttcggaaaaattcaattcttcgccaagaagaagcaattgaatcatttttggtcgagatcaaatctaaaaattataaattagtatatatccgcgatgagactcatatcggaggcgatctaaaaatcagaactaataaagatgatcctttttttgaagaaaaaatgcaaaatagtgctaattttgtctttaaaatgacagcaaaccctgatcaaaaacataatctaatcgaattaagtgaaaaagaactaaatggcgataaaataaaactgctaaaaacaaaaaaatactataatttagggcttaagtcaaatttagaatatgataatgaaataattcttaatgccacttgtaatttatcttgagattaaaacttataaaaatgataatgatgagcaaaaaaccgaaaaattatatgaaaactataacgaatatattaaaacaaattccgatagcaatattaaattaacaatggtcacatgttttgttgatattcacaaaaatgttcgagaaaaagcgctatatttttccggggcctgatcaatttacaagttaaactcaaaactaaatgacataaatccaaaccagaaagatcttcatgatataataaaaagtaattctattctaagtttatttgaagcttttaagttattaatcaaaatgaaggaaaatgcccatatttttttaaaaaatatgggaatttttgcaaaaaacattaatttttttgcaaaaatttaaaaaacaggaaatataaaactaagaaaaactagtaatattttttcatatcattactaacagaattaaaaacaaaaccaactagcttatcttgttcttcaattggtaaatttggattagtttttattacattatatgcataaataaaggcaggatggagcgagttactaagtggtcgcccaatttgatatagattacaccattttgcatttaattttttgcgtaaggtttcatcaacaacttttattcggtattccttgactaaattaagataagaaaaaattttaaaaattccaaatgtgagtcaaaaatttttaacgcattccgatcatttaatcggtataaaaaaacaaattccaaagaaataactcaatgtaggaaatcaagaaatataatatagaatttcgatataattattagttatctttaaaatattttcgtttatgataaaaaatattaatttatcggtaaaaagtgggcttaataaaaaaattagtcttactaaatagttggttaataaaaaagacgagtctaaaatataataaaatataattttttggcttttttgccgatttttggaattattaaaataaattagaacttgaataatcatcaaaaaggcgataaaagaactaacaaatacgatatatggtcaaaaaataaaattaccaaaaccagcaaaaattaatcaaaagattaacatcaaaaatgagacaaaaaaggttataattgtataatagaccgattttgccgtaaaagaaatattttttcaaagcttttcaaggggatttagctttttttctagagttttttcatgtttttgaaaaatttcaaaatttagttgataaaaactattgatccagcttgtatgttgttcgcgataattcatttttgcgtttagatcagaaatttcaacaactgattttgtatcggcaagataattaaagaattgattttcatcttcatgtaacaggtttgaatagtttttttttaccttttttgtagttttttttggctcgacaaacacattatttatatttttttcttgtttatcctgtcctgcttgaaatgtagttctattttccaaataatttgcataatttgcactatttttagtctgactataatattcaggactattttttgcctcaatttcattttgatttaaattaacttcagcttcctgaatgtttccatcaaatgggttagggttgcttaatttttgttcttttacataatttgctttttgaaagttgctattttgctgataattacggtcgcgggaggcaaaattactattttgacttttgatattactgttttgactagggtttctagggatgaaaaaatttgattgttttgcctccttaaatttagagtttgccttattttggtcctggtttcaattcataaaacccctttttcctcaattttttacttgtttactattttattttattttatttaattttaccataaatagctgattaagttagcctaatttttgggcaaagttaaaaaaaactattaacctaaaaattcataatctgttttaaaccttaatgtagtttaagtatttttacaaaaattaaccgaataaaacaaatttagctaaattttcctaaatttttccactggataaattatagttgataaaattagaatttaaatttaattactttgaatttaatatagaactatttttttataaaatttacttatttatattatataggcaaaaacaggatttaattgttttatttactgaatttttaattttatatttgaaattaagtttcaaattaaataaaaatttataaaaaacaagacttttttataaatttttctaaaaaaatgaaattttcgaaaaataaaaattaaacaaaaatcttttttcagagaaaaattacctagaaattaattactcaaatttttttattaattaccacttttgactaaaaatttgcaattttttctaaaaaattaaccacaaagttatctaattttaataattaagctaatttttggtcatttttactccacttaactaatttttatataaagaatttttattttttttcggtcgacttattttagtaaaaagtaatttgtaaaaataaaaaaaatatttttttggttttttttctttgttagtgtataattgtggttgatagtggagacaagcggaaatgtttggaactgtttttagaatattagacgagaaaaatagaattgtaatgcctcctgcttttcgaaatgaacttgaaggcgacttttatatttctgctaatttggagaaaatccttgaaatcagaagccagacagaatttgacttgttagcccaaaaaataggaaaagcaaattcactcgatcctaaacttcgtgattttgcaagatatttttttgggaatacagtcaaagtttctgctgataaacaaggacgatttttgatcccgaaaaatcttcttgatcttgccactatcagtaaaaatttatatttaattggggttaataacaaaattgaaatttgaccagaacaaagatacgaacaattttatgcaaaattttctgatagcgaaatgaccgctgatcttgaaaaagagttgctaaaatcgggagttgaattataaaatgcatgttccagttttgttagaggaacttattttagccctggaaattaacccaaaaggattttatgttgatttaactttaggacgcggcggacattccttagcgattcttgaaaaaattagtaatggaaaattggttgtttttgataaagaccaggatgccttagatcaaacaagaccaaaattattggcatataagcaaaacattgaaattatttggtcagatttttccagatttgatttctatcttgaaaatttaggaattcaatttgttgatggatttatcatcgatttaggagtctcatctccgcagattgatgatcccgagcggggattttcatattctaaagatggcaatttagatatgcgaatggataagagtcaaaaacttagtgcttttattgttcttaatgaatatccctatgaaaaattagttgaaattttctttaaatatggccagattccctatgcacgcgaaattgccagagcaattattaactctcgccctttgaagactacttttgagctggtgaatcttgtaaaaaaagtaattcctgcgctggtgttagttaaaaaaaattttataaaaaatgtttttcaggctgttcggattgaagttaataatgaacttgattccttgcaaaagttgttagaaaagttaccaaaatttttaaagcaaggatcaaaagtagcaattattacctttcattcgttagaggatcgaatcgttaaaaaagcatttttggatctaattagaaaagacaaactggaattttttcaaaaaggtttaccaaaattttctatgaaagttttccgaccaaaagctaatgaattaaagtcaaatccgcgagcaaaatcagcaaaattacgacttcttttaaaaaatagataaaaattggaaccaaaaaaaggtagaaatactatggaaaaatgtagtaaaattatgctaatgggattaggtgattttggatcaaaaattgttgagtcaatcaattttgatcaagctagttttccaaaattttttattaattcagctgatgaatatacaaattccaattttttaaataggcaaaattcactaattattccacaatcaaattttagatataactgacaaaaagcaaatcgggctattttagataaaagtttagaaattaaattggcccttgtcaatgttagaattttgtttttgattgttggtcttggtggcgcaactggttcaggttttagtcttgccattgcaaatattgcccaaaaaatgggaattatcgtaattgtaattgcaacaaatcctttagaaaatgaatcaaaaattcgccagcaaacgagttttgatgttctcagtgagctaaaaaaagtagtggattcattaattataatatcaaatgagcaaataagcgaaaattattctggcttttttcttgaaaatatatttaagttaataaccacaaatattcaagccaaaattggaattattcttaaggctttctgccaaaacaatgcattagttcatgttaataattcaatcagcgagtcgattcttgcaaataataactttgttttcgttacctcagcaatcgctaagggtgaaaatcggggaattattgcaactaaaaaggcacttaaaaaccattttgtcgaatttgatcttttcgctgcggaagaaatgttagtaacaataacagcagataattcgattttacaagccgaaattagcgatattcttaacattatccgcaaaaatttcaatcaagatttaaaattttcatacggactttatcaaaatccgcaattaggaaatcaggttgaaatcggcattatcgcatcacaaaaaaagcatagttatgaaagtaaaaaagcagcaaaattaaatcttgctttcgataacgcatttaatatcttttaaaaaaattcagttttaaaatttatttaccttttaaataaaaaaataaacacctttctaaaattataaaaattaaaagtttgcaaaccataattttataataaaaaggtgttttttttataatttttttaaaaaaattttttttacttgcaaactataaaaaatatagtataataaatatacgtaatttttcgctccttttttaaatggggctttgattttaaaactattatgtctaaatgaaacaaaaataaatatatatccgattattttttagatagtcaaaaagttcttgcaaaatttaacccaaacaacatcgtcattttacaattttttcaacgccgcgaatttgctattcttgctggaatgaaagaagttattgaattactaaaagaaaataccgattataaaaagtataaaattcgctatttaaaagatggcagccgtcttgggaggaaagaaattgtccttgaattagagggtccgattcatttatttggtcattttgaagggatgattgatggaattcttgcccgttcaacctcaattgccacaaacgcttatttatgcaaaagagcagctaacaataaggatattatttttatggctgatcgttctgatcattatcttatgcatgaaattgatggaaaagcagcccgaattggcgggataaatcttttttctaatcaagctcaagcaggaaatgtcagcttagaaaattttggttcaatgcctcattttttaatccaaaattttcaaggaaatttaatcgaggcttgtagggcatatgcaaaagtttttcccgaaaaagaattagttgcgcttgttgattttaacaacgatgttttaactgccgcccttgaagtgcttgccgaattcgggccaaaattagcgggtgtgcgaattgatacatctaaaaatattgcagataaaatgtttgtagatccccaaagtgatgaatttggaattaatgcaaaattagttaaaaaattacggcaagaacttgataaaaacaacggccaacacgtaaaaattatcgtttcctccgggcttaatcctcagaaaattaaaaaactagaagaagaaaatgcgccaagtgatgcctatggagtcggtgaatttatgcttcagcttcggcaccattttagtgctgatgctaccgttttaaacaatgaaaaaatcgctaagtttggccgcttttatcgaaaaaatccaaaattaatcagtcttgttaatgaaaaataatcttgaactgaataatttaggttataatgacgatctaaaaatttgacaagataaaactagctttaattattcagttgatacaattttgctcggaaatttccttactttatcaaaaaaaattaaaaaagcactagaaattggcacaaataatggcgctttggcaattttagttgctcatcgcaaatctttgcttgaaattgatgcactcgaaattaatgaaaacgctataaaaatagcccaaaaaaatgttgaactaaacaaaaaaggttcacaaatcaggcttattcatatggattttaaccatttttgacctttgcataatcaaaaacagttgcaaaaatatgacctaatttttgcaaatccgccttattttaaaatcggaactaaaaaattaaaaaaggttaattccgattttttaaatgccatctatgaatttagtcttaatttatcacagttgatttcaggtgcaagtaaaattatccaacaaaaaggcaagcttgcattagtcttgccaattgaacgttttgttgatctaattgaactattaagagaaaatcattttgaacccaaaaaaattcagtttataatgacccgggttggctcaagtcccaaatttgcactggttgaatcggaatttaaagggcaatgagggacaaactatcttcataatctttatcttcacccgcaaaataaaaatttacatatctatcgtagagaaattcaaagattatatgttgcaagaaaggtcaaagatgactaaaaaatgttatatcacaactccaatttattatgctagcgggagactccatattgggcatctttatacaacagtgcttgcatgagtaattagaaattttaaaaaaatgtccggatttgaggctagattgtttactggttctgatgaacatggtcaaaaaatttctcaactagctgcaaaagcaaatcttgaaccccaggaatttgttgataaaaatgtcgaaaatttcaaatttttatgagaaaaatttgaaattgactatgattattttcaaagaacaacaaatttaaatcataaaaattttatcaaaaaaatttttctaaaaatgtatgaagataatcatattttcaatggtgaataccaagggctttattcgataagtgatgaggaatttctcagtcaaagtcaagctgtttatcaaaatggaagctattttcaccccgttagtggggcaaaaatggaattaataagtgagaaatcctacttttttccgatcaaaaaattccaaaaatgactagaggattttcttttggaaaatcccaaattcatttttgattcaaaaatcgcaaatgaattaaggcagaattttttacaaaagggacttgaagacttatcagtgacaagaaaaaatctaaaatgaggtatttttcttgatcaaaaatttgaaaatcagacaatttatgtttgacttgatgcactttttagttatttatcagtttttaaagaccaaattgatttagaaaatcctaagaaatcaaatttttgaactgattctgcccaaattattcaagtagttggcaaagaaattgcccgttttcactgtatttattggccaatttttctaaaatcgctcaattttccccttccaagcataattttaactcacggttgactaatcacccctgagggaaaaatgtcaaaatcaaaaggaaatgtgataaatccacttgatttgctaaaaaaatttgatccagaaattattaaattttattttgtcagccaaataaacactaaaaatgatagtgtttttgatgaaaatttattagaaaatttttataattctttttttgtaaatacttttggtaatttaataagtagaacaattgccttgatagtgaaaaaatttgatcagcctttattatttgaaattgcggatcttgattgaacagatattagtttttatgagaaaatcctgcttagtttagatgaattttgcgataactttgatcaactagaaattgaaaaagcatttaaaacagtaattgaattaacaaaaaatttaaacggcttttttgatattaaacaactttgaaatcaaaaaaatttaaaaaaactggcccaaggtttaattttggttctcaatggaatttatgctataactgtttttttaagcatcgcaatgcctaaaaaaactaacgaaattcttgaatttcttggaattaacgagaaaaactttctacttattactaaattagataaatttgataaaattaatttcaaaaaattagaaaaaccattttttccacgaaaaaattaataacctaaaattcaacgataattatgttttttgtttaaatattggactagaggaaccaaacggattaaaattagggcataaattgggaaggaaacagttgattttaaaataattggcgttagataaaagaaaaaataatcctgaaccagacggtcttttcctttcctgttaaaaaaccgattataatattttataaaagcaaaaggatgtcagagtcagcggaaaattaaaaaacaaaaaccaagaacaaaaagtgttatcagagctatttttaacttttttgttcgtttttttcaataaaaaatcaacaaaaaagttgagaaagtaagcagaattgatccaaaaactgcaattaaaattagaactaattttttgctaaagacattttttcagtcttttgctactttttttattacttgttcttcactaaaaaagtaataaaaaaagacgaaaatgacaattatatatgttccaataagcaaaaatattaaaaaaatatctttttttgtaactaaactaaaaattaaagacgaaattattgccactaaaattggaataattccatattcaggggttcaaaaaataactcgacttgttagtaataatttaccaaaatcaaaactaaaagcaacaattattcccttaaatcaatgtaaaagtataccgattagaacataaaatggtaattcaaaagcgatattaaaacgagttggaacagtagttttgaataaaaaagaaacaattaagaacactgccattaaaaaaccagatattactaattcaaaactcgaaaaacgaaaaatcaaacggtttttgtaaaagaaatttttaattttttttacaaaattacttaaaaacagtgtcataatcacaaattatagcaaaaaatggacaaaaaatttgaaaaaataaccaagtaaataaatttttttttaaaaaaattacttaaaatattgcatatttttgaaaatttctaaattaggcaatattttaatttttattgttactaatatcaatcaaaaactaaaaaattaatgaatttatttttaaaatttatttttaaaaactaattttacttttcctcagtctctgcaaaaatatttaaggcgttagtagcagcggcaaattctgcttcctttatcgatctgccatatccaattccgtacttttttttctcccaaataagatcaacgcggaaagttccatcaactaattttgtgtgtaggtagtggatcttgtttgaggttgaaaaagtttgaattttttcctgaaaaattgactttgggtctttatactgtttttcagtatcaaaatttacatctttatataaatactcagacaagaattcgtttaatttctcaaaaccttgatctaataaaatcgccgcacaaaaagattcaaaaatatcggcttttaacttgttgttttcacgaatttcactagcacctctaccaagcaagacataattcattagcccaactttttttgttgcatttgctaaactcgaagttgatgtaagtaaggatcgaatttgggttgaatttccctcatttttataaaaattatcataaatcacctttgaaaccgcataattaattaccgaatcaccaagaaactcaagcatttcataatgtggtttatcaggattaataaaattataacttttatgagttagcgcttgaatgtaaatctgttttgaatttgggattatttttaatttttttaaaagttcaagaattttatcttcaatttccatttatctccttattttttatagaaaattttaaaaatttttgtctaaataatattttaaaattaaattaatcggcaagaaaatttattttaaaactttgttgcccaattatatgtggctgacttgagtgaaaatgaccaaattcaagctcaagttctaattttttattttggtcatcaaattgatgggccatttttataaaacttacttgttgggcaggaagattatcaggtaaaggaatttttgcaacaggtataaaattgagaatttttaattttactaactttttgattacaatgtaagttatttcaccttcatctaaacaggttcttgcattattagcacaagcgaaaggaaattcggtattattttgtgacttaatctcattaaaaaaattgctaaatttatttttaaatttattatatgaataattttgactagtcaattcaagacgatatagatcttttttgaatttatcatctggttgaaatgatggtatagaattaggctggctaaattcaattttaacactatttcccccacaagaaaccaaaaaattaacaactaaaacataggaaaatagtcattttttcattaaattccttctacaaattcagacaattaaatgtctaagttattttaaaattatatcataaaaagtttattaatgattaacatttaaatttaattaataatttctttagcggatttcttaacttttttccatttttttatataattatttagatacttaaatttattgcctgttattgaggaggctaaatgacaaaaaggaaaaaaattttactttcattatctgcaatttttccaattagccttgctattggcggttattttatttatagttatttttctcgggcttgattaaataaaaattttagtggtcttgagctacttctaaatgataaatccataaaagaaaaaagtcaaaaaaaaattaataaaattgatacaaatagcataagtaattttttagaatttaatagttatgctacttttgcaaatcaagaaaatgatgatttaaatatggaattaggtcagaaggaagctttttttagtatgctttctgattttgaccttgaaaaaattaagaaaaatcacataatttttcccgaagaatataagatgtttaattttaatactgataataattttgtcacaaaagaaaatgagaaaaaatttcttggctctgaaaatgatgatttgttagtctatgatctaaattatccaaaaattaatgagctaattgaggaaaaagaaccatttaaatctgatattttgaatcaaaaatttacactttttgattcaaaaagcagaaaccaaatttttcagcttgataaaattggtgtttattctcaaccacttaaatcaaataaatacgattcaatttaccaaaaaaatattaaatttcgcactgcaacggcaacgattttagatgctagtaacggcaaagcattattgatcacaaataatcatgtaataaaaccaagcgaatatagttataaagatgcaaattttcaaataaattcgcaaaatttaagattttgaaataaattaggcggtaattttatcgagtgatatgaaaatggcaagatttatcatcttgatagggataacaccgcttttcttttttatttaaaagaggtttttgagaataaagtcacaaagtttgatcaaggaaaagttttagagtttcttattgatttttataataaatatttcttaattcctactgattttgataataaaaaattcgatgttggcatattttattttaaatatcaacaatttattgaagacttaaaaaatcttgcaaaattttataatgaaaaaagggaggaaatacttaccagaattcaacaaaataacaaaattaaccataatagcagcgagagcaaaaacacaattgagtccaaatttaatgattttttaggctcatatcaaggatttattaatttctgggaaaaaatgcagaacgctcctgctgtaaaaatatcaccaaaaatttgaaaaaaaggagattttagttacgatctcaatctttccttgttctgaccaaagtcaaaagcgatgaaaaacaactttaaaggggtttatgccactaacccacaagaaaatttttctcgactctccttatatttttatacaaacaacggccgcggagcctcaggttctggtgtttttaacaaggatggcgaactacaatttattaatgcatttggcttaattgataatttttatacggatgattcgaaaattgaaaaaaattattacgataaattaaataccaatatttcattatcaggtgggatccccctggttaccgaagaatataatttagctgaatcgatcaaacaattttatccatcaaaccaaaagagtggctttaaataccttgccaatgaaaatgttaaagttataaaagttttaaaataaaaaactcgtaagtttcaaaattaataaaatttacgagttttttatttttcataccggcgcaccagttgatagaattattatgaggtgggaatttaacccatatttccaaaaataaataatatttagtttttgaaaactcataataaatatgaaatcgaaaaatattataccacaaaattatttggttaacatttttttttttttttttttttttttttttttagttatctatgttaaggctataaaaaggataaaaaaattattttacaacaaaaaaagtttaattttctaaaaatttaaatttttttattagaaataacaaatttttttacgaacataagattaaattttaaaaatttagaaaattttataattcttgtatttttgatagaaaatgttttaattttaacttatttttattttaattatagtaaaaaaacctaaattttatgatataataaaagagtttttataataatatggggtgaaaatatgttccaaactattaacgaaatttccattcatcctgaattatataaccaaaaaaaggttctaattcagggctggataactaacattcgcgggaatttaaaaattatatttgttgaattaaatgatggttcttcatttaaaaatttacaatgtgtattaaaaaaagagtttattgactttgataaaatagaaaatttagccctcggtgttgcagttgaaatttccggaattttttcaaatacacctgaacgtcaacaatttggcgaagttttagttgagactttggaaattaaaggtaataattataacacaaattttccgattcaaaatcaggaaatttcccttgaggttctccgccaaatgcctcactttcgccatcgaagtcgtttatttcgtgttattatgaaactaagatcagcgctattttttgaaattcataaattttttcgcaggcaaggatttattaatttttcagccccaattctaacctcaaatgatggcgaaggagctggtgaagtttttatcgttgatgatgaaaataaagatttttttaataaaaaaacgaccttaggtgtaaccggacaacttcatgctgaagcttatgctcttggttttaaaaaagtttatacatttgccccaacatttcgggctgagcgttcaaatacgagaaggcatgctgccgaattttggatgattgaacccgaagtggccttttttactttagaacaaattatcgaattagcagttaaattacttcaaaaagtaataaaatcagtaataattcgcaacaaagatgagtttatttttctagaaaaagccggggataaaaatctccgaaagcgtttgcttcaattttgtgattctcaagttactcaaataagttatgaaaaggcgattgaattgcttttagaacatcaagaaaaatttgaggaaaaagatttattttttggctgtgatctaaaaaccgaacatgaacggtttttaaccgaagaaatttttcatatgcctgttgtaattataaattatcctaaaaatttaaaagctttttatatgcatcaaaacgaagatggtcaaactgtagcagcctttgatttattggttccgggaattggggagttaattgggggctcacaacgcgaagttcgctatgaaaaattattagcgcggatgagtgaattgaatatgaatattgaagaatttcagtgatatttagatcttagaaagtatggtaatcctggatcaagtggttttgggcttggttttgaacgacttttaatgtatattactggaattgaaaatattcgtgatgtaattccctttccccggacaagtaaaaatattctaatgtaaaacagggagaaaattgaataattctgaaaaagcacagttttgacgtcgctttctagctggcttaattgattttatcctgctttttgctttgtttttattatttttttatttatttttgattctaacaaactgagcaaaaataaaattttacctctgaattataacagttttttttctaacttttacttatcgaatttttatggtaagtttttctttacaaactttaggtcaatttttaactaatacaaaaatatattttcttagagaaaatcttaattttaaagcaaaaattttagttttactaaaaaaggaaatatttttaagtcttaactgaattttaactatatttattactagtttattagttgatttaagttttggtcttaattttaatttttttgaaaattttatcagtcaaagtcaaaaactaaatttattccaacaaattagtcttagttttccggccttattagcaaaagttaacttttttttcttaatcattaataatttatcaatttttagtaggcataaaacaacaattattgaccgttattcaaataccgaaattcatcttaaaaaatcaggtctagccaataattttttaaatgcaattccggcgaattttatcccggttgattggaaaggtaactaaaatgtcatcgcaaaatattttattacaacttaatgaaaaacaaaaaattgctgttatcagtaactctagccatctaagaattgttgctggtgctggcactggtaaaactagtgtgctaaccaaaaaaatcgcttatattatcaacgaatctcttgcatatccaagtcgaattttagcacttacttttacaaataaagccgcagaagaaatgcgtaatcgggtggaaaaattagttggggaaaaatcaaaggatattcaaattcttacttttcattcactttgtaatttaattctccgacttgaagcaaaaaatattgttgaactctctgagattccgcttagcgactaccgttttaacattattgatgaacaagaccagaaaaaaattgttgaaaaacttttaggaaaatatctaaaagcaaacgatgaccgcgatgagacaaaaattagtgcttttgatgcaattaaattcatttctaatgccaaaaattgagaaaaatcacctgaggatttgctaaaaagtataaataatgaacttgatcaaatcaaagttcaagtttatcaaaaatatcttgaaaaaacaaaagaaaataacattattgactttgatgatcttttactttatactaaaattgcctttgaaaaaagtccagaaattaggtctagatggcaaagaaaatttgattttgtccttgtagatgaattccaggatacttccttggtccagtatttaattttaaaaatttttatcaaagataaaacacgtttagttgttgtcggcgatcctgatcagacaatttattcttgaagaggagccgatccgtctttgatcttaaatttagagcaagattttcccgatctccagacggttattcttgataaaaactaccgatcaacgcaaaatattctcgatgcggctaataatttaattgaaaataaccaaaatcggatcaaaaagaaattagttgctagttcaaaggaaaaaatcgaaattcactttgaggatttagccaatgaaaggggagctgaagttgaatgaatttaccgaaaaattcaggaattaatcacaaaaaataaggtaacttatcgcgatatcgccattttagcacgctcaaatttttattttaaacaaatagaaactaaatttgatggccataatattccgtattttcggcacggagcttccccgcttgtaaccaaaaaagaaatccgtgaagcgctttattttctaaaagtaattgataattccgatccttatgcttttgaacagattatcaatgtcccgcctaaaaaaattggaatagcaacaattaacaaactaaatgaattagcagcccaatttggtcttaatttacacgattttttatttaaatattattctggtaaaataaattttaaaggaaaacaaggaaaaattcccttaggccatgataatcagcttaaaattaaggtacttttagaaagaattagcgccgcaaaacggtttaaaagtcaaattgaagaaaaaaaaccttgtatttttcagttttattcgcaagttcttgactcttttttgaaaaaaattgattattttgatgcaattaaagatgcaaaacaagcctctgatactcgcaatcttttagaaaaatactataaaataatggataattgacaaaaagccaatcctgaaaaaaaattatccgactatcttgattatgcagctatttctcattttgaacaaactgaatcacaaaataaaattaatttattaacagtacattcctcaaaaggtcttgaatttgaatatgtttttcttgtgggaatgaatcaaggggtttttccggcccaaaaagtactcgatcagaactcgacaagcgaatatgaagaggaaagaagactcgcttttgtagcagttacgcgcgcaaaacgagttttatatataacaaatggttatcgcgcgccttcttttgcccgcggtttgccacaaaaatttaaaactaatcaaaatattgtctctgcttttgttaaagagatgaaaattaaagctgaacggtttgcccagtttcgtaaacttgatgaaacaggaaaactaaattataccaaagataaatcagaaatagtggaatttgttgctggtgaccaaattaatcacttaaaatttggtcgtggcatcgttttagaggtcagatttgactcaattttagttaaattttttgaaattcctggcgataaagggattaaaacactaataaaaacacataaatcaatcgataaaataacctaaaatgctattaaattgacaatcttatttactcgttgccctgattattttaatctcgctttcgtttcttcttttattaatttttagcttagtttttatttataataagaaaataaaaacaactaatattgtcccgctaacttacgatgttgatctaaaaaggatccgaattaacgatgttttttcgctcccggccctcaaatttataattaaaaacaaaaatttactatccggactttgaataactcaggcggattttgtcgaacttcttgaagagaaatttcaaaaaatttttttcaatagccttaccaattggcaaaagcaaataatttcaataaaatttaaaaaaaaatttttttttaacaaccattttcaggttttttttcaggcaaaaccggaaaatggttttgttatccaagaggtagaaaaaccatttttttctttaagaaagaataaaaaaatctttaaaaatcgagtagtcgaaaaattaattctgaattttgagcttcccagttttcttatagcttttagttttccagccaaaataagtactgaatttattaaaaatttttttcttgcatataataaaaaatttttatttttgaaaaaaatttcagattttcaaatttttagcttcgagaatattttaataatgcagatttgcgcaaaatcgacaacaatacttgaaaaaataaaaaattattataaaaattatctaaaaaatcataatttaactacttttttattttgacttattattgatctagaccgtaaaattaattatgactgaaaaattgaaattcagaaattttttgatttaattattaaggaaaaaaccaactttttagagttaaaatcaagtagaaaactttttcgacaaattattgagactaacgaaattcagcccttatttaatattgaaaattataaaattggcgaggttaaagattttaaaaatcataaaattttctatcaggtctatgattttgacttttataatagtcaaaaaatttcggacttactaaaattttttactgaaaagtcaaattttgaccattctagtaaaatttataaaattaacgatgtaattgcgcaaaaaatgcgtaatttagtacttgattttcaaaaattcacctttttaatcacttcagaaactaagattgctgatattgatctaagttatattgacaatctttgctatcaaaaaactgttgattcaaaacttttttactatcttaataccaaaaaaccaccattattattcctaaatgataattttaacgcgcttgagaaaaacgaggcaaacgacatcattatttcatcgcttggtgaatatgcaagaaaagaaaaaattaagctggtaattaaaaaagaaatgatcagaagatttaatttttcccagaaaaattttccgctttattattgataaatcggaaaattaaccaatttttccttattttttccttttttaaagtttttttgcaaaaaattttaattttagttgaaacaaaacaaccaaaagggagcaaaaaatgcaaatctatcaattcggaaaaattgtctcaaaaaacaaaaactatttaattcttgaaaaccacggcagtggctatcttatttatgtacctcgaatcgatcgttttagccgcgacgaaaatcgcaaaatttatatttatgaacatgaaaatgactatacaaaaataacttacggttttgcgagcttccgtgagcggattttgtttgaagatctaatttcaattcaaggggttggacctaaaaccgcaatttctgcacttaattcgggaatgcagaatttaattaatttaattgccgcaaacgactgaaaaacgctggcaaaaattccttatctttctgagaaaaatgcaaaacaaatagtctttgaatttcaaaaaaaatacgaaagatttaacgaaaaccataaaaaccaaacagaggaaacaaatcaagactctcaagaaaaagaactagaaaaaaaggatgatttagctgatattaccatccaaaaatcaaatcttgaagacaaaacggccgcaaatcttgaggatactttgaaaatgcttggtttcaaaccacgtcaaattgattatgcgcttacaaaagttgaacctaatgaaaattttgaaaatttaattgaaaacgcaattaaaattatatcaaatgccagagaatttagaaattagaccaagcagttttgaaaattttatcgggcaaaaaaaattagttgaaaccttacaaattttaattagctcatcacaaaaacgaaagcaatcacttgatcatattctcttttatggaccaccaggaacaggaaaaacgacactggctaacatcgttgcaaatgttcttgaggctaaaattaaatatgttcaggggcctttgcttgaaaaaaagtcagatgtgcttgcagttttagcaaatatttcgccggataccatcatttttatcgatgaaattcacggaattaataaaaatattgaagagcttttatattctgcaatggaagaatttgtaattgatcttcagattggcgttgatggggagagaaaaattatgcggatgaaactcccgcaatttacactaattggcgcttcaactaaacttgctcaaatttcaacgccattacaaaaccgttttggttatgttgctaaaatagttgattatacacttgaagatatgatccagattattcggaattcctcagcagttttaaaacttaaaatgaatactgaaattattaaatatattgcaagtttttccaataatacaccaagaattgccaataatttattaaaaagaattcgtgattttgcgctagttttaaatgcaaaacgaattgacaaagacattgttaataaaacttttgatagtattggaatttataatcaaggtctttcgcagataaatattgaatatttaaacctccttgtaaaaatttttaagggaaaatcagtggcacttgatgtaattgcaaatgttttaaaagaacatcggcaaaccattatcaatattattgagccgccattaattgagaaggaattaatcgagaaaacctcgcgtggtcggaggattactaaaaaaggtagggattatttactcgaactaaaaactaattaagttacttttttagctttaattctcaaaaagtgtaactttttggggtttgattaccttaatattagacgcattatttgcatttttataaataaatttgagaaaatctcagaccataatcattgcaattacatcattttggcaataaatttgcaaatttttctttgttatttcccactgattatcaccaataaaattaaaataacgatcaattgattcgatcatcgcctcaagtccgttttttattgctaattgtttataagggattattaatcttttaaggttatatttatattttgtgataaaattttcaatttttttaattgaataacagcccttaagatccgagattactagtcaatatttcgcaaaagggtcttttaaatcaatcgtttttttaataatttcagctacttttaactcatattcttctaatttttgttttgctttatgatatggaagtctttcaagataatttttgaaaattatctcaagcatttcttttagtctagtgagttcataagatttattaaaaaccacataaaaatcggcatgtttatgataaattttatcaattataaggaaaaaattttctcaagtataattttttggatcaaaaacaagatttctatctgaaaaattttgattcaaaatttggcctctattagttaaaactatcgaaacctgggaaacaatttgctgaaagggttggacataatcaattggcggaaatggaagggaaaaagcttcaaaatcataccagacaattttttttgcatataaatttagtaaaaatttttttaattcctcaatttgattaataataatgctattattttcttgaaaaaaattaaatcaaaaagaatttttttcaagcattagtaatttttcttcatcttcgattagcgataaggcatcttttgcttttaaaagggtaccactaatatttgcaagttgaggataaaattttgtcatcagcatattaaaatcaggatttttttcaaaattcccattatcagaaatctgtggtggactaaaagtttttatgtttttagcctctttgatttcggataaagcatcaattattggaatcattttgataatttttttggtttttttaggcccctttggtgaatttctactaactgtgtttctaagaagatttttaacaagacgattttgttcaagaaaataaggattattaaactctaaaagtgtaaggccgttttgtttagcgattttttttgcaaaaaaataataaggaccttcacgatctatttttgaaactgacttgacacctttgttagttgaaactcataatgtttcacaaaattcagtttgattttttcttggattctcaactgtatcaattaaaaaataagaaacttcttcaattggattaagatcatttccaaatccacgaagcgcataagttgtaattcaaaaatttcaatttgcggctaaatagtctttaatttttgttgaagttgataattttaggatgcttatttttttattaaatacaaaaaatacagaagaatgagctacggcatctttatattcaaaacatgggttaaatataatatcacaatttccacttttataaaaactaattgtttgcgcaatttttttttcaacttctgccggatagacaatgcaaattttcttctcaggatatttttttttaataaaagtatgaaattccgttgtaaaatttttaaaaatattaatgtgtaattcagaaaaatcggtaggattttcacttaaagcttcaaaatttcaaactgtattctcaaaattttcctcatcaaaatcaggattttcgggaaaattagaatctaaattgtttcagatgaaatatttttgtcttgtatgtaaacgaaaatagtgggaaaaattaatttttttcatctagatctaccaaatattttaaaaaattatgtatcaatttctaattttttttctaaaaccgaatgcttaatttttaaaatatttggtgaatcgactacattttgatcaaataaacgggtttcacgtgctaatttattataaccagcaacaattttataaatattatgctgtttctttcatggtagttttactcggaaaataaaactatttccctccccatcagctggccttatataattcgcgatatactcaacatcattattatttatttgatcaaaacccgatgatacaccttcattctcgcgcttgaaaactaaagaataattattaacagtatttgcttttacaacaccgggactaaatttaacttcaaaatcaacatcaatattttcaagactagaatcaatttgtccagcgaattttgcatttgagacttgaacatcaataatatcggcttctgttcgaaatgataaggggaataaattattatcataagttaataattttcctttttgatcataaagtcccgaaattacataattagtatcacggtctaaattttttagactaacataaagaaattgatcagatttaacattatgtttaaaagattgaatttcataatctgatctaatcatatttgcttttcgataatggacatcgataagttgggaggataaattttgatcagaaagagctacacgaaaatcaaattggcttgaaggatctaatgaatccatttttttatatgaattagaaataatcacaggacttggattagttctaaaaacattacctttaacaaataattgttcttctatttgaccatttaggcgaataattttaattacatatttagaatcaggttctaaatcagtaatttttaacaaaattttaggttgattattatgcaaagcacgacgagctgaaaattgaacttgttgataattttcagtattttccttttttaattcaaccttaaatagtttagctattttatcctggggaatgattttaacattattaagaacaagttcgacagattgagattgaagattttggactaaaatttccggactttcttgattaccacacgaaacaagaaaactaggaaaaataaccatcaaactggtttgaaagattaggcaatttactttcttagttcagcttttcattttaaatccttattgtcttcttcttgtatcttaaaaaattatatcatttttcaaaataaaaccaaaaaaaattagaaatttttcctaattatatttatattaaacaataaaattattcttaatttatttgaaaaatttatattccaataaaattggtacaattttatcaaaataatattttttcaatttaacctttaaagtttcaatattcccatttaattcaggatagtcataaatatatttattcgatttccggttagggattaaagtttttgtatttagttagttcttcatcgatctgataaagtccgtatttaaagtgtttttcgtaatttttggtttgtgccgcttgtttaagaattatttttcagatctctaaaagttccttttcttgatcgtcaaaatcataatttccaagactttttagagctaaagtttctttttgactaagatcatcaaggcataattcatttaaataaatagttgaattatttaaatctggatgggctagacttctgatatgattagttagactcaggctgacaaaaaataagtttgaaagcaaaaaacattctaatttatagtgttttttgctttttagttcttgtaaaaaccggttaaaaccatcccctgatttaacaagataggtattttctcatctaccatccattattttaaaaattccggcactaaagacgataaggccgactaaaaaattatttttatgcaatcaaaaatcgttttcgcaataagactttgctcttactaaagcggatgatgcggaagaggtaaagataagcacacttgatcttaggtaagcaataaaataatcattatctaaattttgtagcaggccgtacaaacttttgccagttcttatgctaaaaagaccgttatattcgcaagaaagtcctttttcagggacgaccactctttcgagattttcgctttttcatttataaatagtttgactaaacatttttttagttttttaaatttttactgttttaatgaaaaaaatttcatttttttctttactaagagaattatgcggttttttaaataatttattaacaacgtttttttgggcatctattaaatacattattttttattctttttttggggtaaaagcgcaaggagatagttaagatattcaattagatttatgttatttttgctagaaattccaaaatcaactagcattttttctagttttttaactaataaattaacatcattttccttgttaagaatttctgtattaaaataattaattcgaaaaacatctaaattagttttataaggttgatttttcttgatccaatcaaaattttgctctttttttgttccaaaaccgtgatttatccgaaaaagtctttcataagttatgttagttgcgatattattttgattgtttgtgactaaagtaaaaattctgtttccgccatcctgacggttcaactctcaaactgcatgaccggttgttccacttccggcaaaaaaatcaagaatttttgcatttttattgggatgaatattaattaaatacttaattaattcaattggtttgggatgatcaaaaacctttgttgaaaaaatatttttttgctcctgggtgccttcagttccttgggctaataatattaaattagaaaatttcgaaactctttcaattttttggttattgttatcaacgaattggtattgttttgaaaaaaccttttcatttttgaaaacaataaaaccatttttgattcctcaatctaattttttcctagctcaacgccatctccaatctttaacagcgcggtttccctgatgcctggcttgtcacttttcttgactcccgccagcataataaattttgccattatattcaatcggataatcaagtccttcagatcacgttaatgaggcacgatcaagttggatcaacttatattttcctctttcttgaatatactcatcagaaaatttatatgaaccgtcattaatattttggacataaatatttgttgttaaatgttgaatgttttttgaataagctaatacatactctgttaggacttttacaaatttggagtctgccgctgatccctcgtttttcttttgccaaactaaattagcaacaaaattttcctcgccaaaaatttcatccattaaaacttttaagtagccgtgttgattatcatcaattgagacaaaaattatcccgtcgtcttttaaaagttttttggctaaatttagtcgctcatttaataaatttagtcagccatttcgcgagtatttatctcggtaaataaattttgaaggtaagatattttctttatcatttgcaatctggttgccttcattaaaactagcctgagtattataaggtggatcgatataaattatatcatacccggctgcggtcgctctctctctctctctctctctctctctctctctctcgagaactaaaagatttttaagagcatcataattttcgccaattattaaagtattttgattttgattattttcattggatttaaaactaagattttcatctttttctaaaatagcaacagtatttgtatcactttcgggggcagaatcaaagcgaaaaccggttttaattcgctgaacgacaaactgatagacatattcaagttccttatccgggaatttttcaagaattttgtaggctaattgtttttggtcagaatttagttcttttgatgaaatttcatctaatttttgtttgtatatttctaataaattcaggatttttgaatctgtcattgaaactttcctttattaagataatttttgtcataaaaaatataaaaattataatataatttgctaatatatttagctaattttactttggttttcctttttttaaaaattaaattaagaaaataagaaaatcaaattcaaattttaagttaaaagtttaatttaaaaagtaataaatgcaaaaaaatctttcttagactaacttttttttagttttttgaattttttgggctaaatcttaattataataaccaaaaaattcaaaaaaatgacgagaaataaacaaaaaaacgcttgaccaaaaagtctaaatttaaaattattactgtttttacgttctttttatattttttccctggttttcctctactgaggcagtttcgccatcttttaacgtaactgtaaatgaatttccctcggaagcacgcataaaattatcaacttgcagaggccgcgctatgtttaaaacctttttaatttcagatcttcactgttctcaagcagacgaacttcttaccaagtgcggattcagtgcggcataactttgttctcaaattctgcttgtttttatttcgcctaaatttgaaactgaatttcccgagacaaaataaaccgtagttcccactgaacctgcaacaattggagtcaaagatagggcacacttaaaaggtcgacgcagtttttgcttactttatttacatttacaattcaaatttagtaaatcaaaactcaaaactaaaccaaaagtttcaaagaaactttaaccttataaattatatcacaatttttaataatattttaaaattttatgttatacatttctgaattaaaagcttgtttttaaaaatattcaataatttcatttttagattttttttttttttttttttatgctataatttatagttactttgttcattgtcaagtggaggcgggatgattaatgttaatgaatttcgacctggcattacttttgaatttgaaaatgaaatttatgtggtaatttcagcccaacattcaaaacaaggtcgagggcaagcgaatgtaaaaacaaaagtaaaaaatttacgcactggtgcaattactattaaaactttttctggtggagaaagggtcgaaaaagctcatattgagaaaatttcgatgtcatttctttataacgatggtgcaagtatcgttttaatggatgattccacttatgaacaagtagcaatcgagaatacaaaaattacctgggagcttaattttttaactgaaggaattaaggtaaaactacgaaaatttaacaacgaaatccttgatattgaactcccagctaaaatcgaattaaaaataacttcaacttttgatgctgtaagaggaaatacaacaacaaatccaacaaaacgagcaacattggaaacaggttatgaaatcgatgttcctttatttattaaggaaggcgaaagtgtaattgtatcaacagaagatgggaagtatgtctcacgagggtaaaaacgaaggataaaaaataaaaagggaaaaaattaaaatgctcaaaaataacattgaaaatttagcaataaattctttgaaaatgcatggtgttgctgcggttaataaagcaaattcaggtcatcctggagtgattttaagtgctgcgaaaatggtttatgcattatatcgcgatcatatgaattttgatgttgaaaatctaaattgaataaatcgcgatcggtttattttatcagccggacatgcttctggacttttatattctttattatataatttaggaattctagagcaaaaagatcttgaaaattttcgccaaatgggatcaaaaactccaggacatccagaatatggacatactttaggagttgaggcaacaacaggaccacttggtcaaggaatcgcaatgggtgttggccttgcgatggcgcaggcacatttgcattctaaatttcccgaaattaatcattatacttatattttatgcggcgatggcgatctccaagagggaatatcttatgaatcactttcgttagccggtcatctgaaactagaaaatcttattatcctttatgattcaaatgatatccaacttgattcccctcttgatgtggtttttagtgaaaatgtccgtcaaagaattgaatcacaaggtcttttttaccaattagttgaaaaaaatgatgttaatttaatctcagaagcgattactaaggcaaaaaaatcaaaaaaaccaagttttatcgagattaaaacaattatcggcgaaggtacaagcaaagaaaaaacaagcgatgtccatggtgctccacttggaaatgatattcttactttgaaaaaaaatcttaattgagaatatgatgatttttatcttgcagatgaactaagacaacactgaaaaaatacccttggaaaacgaagtcaaaaagcatttgctgaatttaaaatttcaaaagaacttaaagaatttcttgaaaaagggcaaaatcttgattttgaaattgatttagatctggcaaaaaatcaggcaactcgtaatacttctggccaaattcttgattatatttccaaacatcttccttactgaatcggaggttcggctgatttatcagtttcgacgaaagccaaagggagtgatggagtttttagttgccaaaattaccagggaagaaacattatgtttggtgtccgcgagtttgcaatggcctcaattgctaacgggattgctttacattcagttttacgtccttttgtttcaactttttttgtttttgcagattatctaaaaccagctttgcgactttcagcaattatgaaattgccagttagctacatttttagtcatgattccttaatggtaggggaagatggaccgactcatgagccagttgaacaactcgcaatgttaagatcattaccaaatcttgcagtttatcgacctggcgatgaaaacgaattaaaagcagcctatgaattaattttagcaaaaaaaaatcatccttcagctctaattctgacaaggcaaaacattaaatcttttaattcctgcaaaaaaggctttaaaaaaggagcttatttaataagaaaagcatcttcaaaatgagccctgattgctaccggttctgagctcggtcttgccaatgaaattgctaataaattagatgttaatctaatttctttatcaaattgacagaatagtccaatttgagatccaaattatgcaatttcacttgaattagccacaacttttggctgaaaagcgcatgcaaaatataattttggccatgatgatttcggattttcagccccagctgataaaattttagaaaaaattggctttaattttgataatttagttacaaaaataaagaaaattataatttagattaaaattttctttatttttgtaaaaaaacattaatagaaaataagtaaaaattctcactttttatttttcttatttcaattaaaaatatggacctttttaattgaaataagatttttttctatttttaatttttttagtgtataatattatttaattatttctccctattatgtcagaaaataacaactcgtatttatcgactaagcttgaccatttttcggcttgaaaaaaagagcggaaaattgctctaattttttctttgattattcttggaatcaccttttttctggtgggttatggaatgattaataatcgccaagaatttgtggttgataaattttattttattagttttagtaattatttccaaaattttagtgtttttttctatctaacttaccagtcaaatctcatttatggacttgttttatttagttttgtcctaagaccttcaaggctaaaattccaatttttatttgtttttacagtgattttaactattgttttaattgttttttgaaccgtaattgcctgaaatttacatatggatattacttttttgctaaaaacttcaacagtccatttttttcatcccgttttttcaattctcgtgcttttttggtttcgcaaagaatttatggtcaatcatcttggcctaagtcttgctgttatttattctgtttgttattatttattttgtctgcttttatatttttttacaattagacagtgaattagtcctgaatttaaggcaaataatgaaaatatcccagaaaaaaggtcagtttttttctatacaggactaacaatttatccctttcttaactttttacacccatttttttattcaggtgataatcattcaatggtgattctacttaatttgctaatgagtttctcagttgtattacttccttattgaatttcgcttttttacattaatgtttttggaatcaaagcactaaattgaagcttttttgcgtggattaaatcgctttttattcgcttaaaaaactttttttgggttgcaaaaccaaaaaaagaagaaaattttggagaaaaatagtggcaaaaatcgttgtaggactttccggtggggttgattcagcagtgagtgcttatcttttgaaaaaagctggtcataatgtgattgcagtttttatgcgtaattgagactcaagtcttaataatgattttttaggtaaaaaaaatgaaaaaaatttcactatttgccctcaagagcaagattgacttgatgctaaagtcgtagcaaaacagttaaatatcccgattttccgtattgattttatcaaagaatattgagatgaagtttttagtgacctaattttaaaataccaaagcggcctaaccccaaatccggatattttatgtaataaaaatattaaatttaagcactttcttgactatgcccaaaaagttcataatgctgattttattgcaatgggccattatgcaaaaacagataatggaaatttgtatgccggagctgattctttaaaagaccaaagttactttcttgggcagttatcaaaatcccaacttcaaaaaaccatttttcctcttggaaatctgcataaatccgaggtaagaaaaattgctaacgagctagggctaattaatgcaaaaaaaaaagattcaaccggaatttgctttatcggcgaaagaaaatttactgattttcttcagaattacattcctgcccaacccggtaatattattgatatttctacaaaaaaagtgcttggaaaacatatcgggattatgtattttaccatcggacagcgcaaaggttttggactaagcgggatgaaagaaccttattttgtagttggtcataatttaaaggaaaaaattttatatgtatcaccccaaagtgaaaaaaaatgacttgaatctgatagtttaatggctaaaaacgctaattttttaagtgaaaattttagaaatcttgataatttaagtgcaaaattccgttatcgccaggaagcaatcccaattaaaatcgaaaaaattcaggataattccttctgaatttcctatcaaaaatatcaggcaatcacgccaggccaacaagttgtaatttatcatcagaatcaagttattttagcaggcgaaattgctctactttttagaaatggaaaaaaacttgactatcttgactagaaaaagcaacttaatatattcccaaattaatttaaaaaattaaattaatttgaaaaaagtgcggttataaccgatcacttttgatttgattgtttgcagaacatcaaaggaattaagtggtctatctaaattgcgtgcaatctcacttcagttgatttgactatttagaccaaaaatttctaactggtactttccttgtccgcttgttaggccactaagataaatcaacccatattttgacttgataaattcaaacttttcttctgaatctagtcctaatttttgagctattgatccagcacaaaatagaccaaaactatttagaattggatattcactttcgaataaatcataaggatttttacctggttttaactcggttttatagtcgttttcttcctttataattcctacccgaactcaggaattaagaccgactccaagtgaatttgtctcggcaaaacttgtaattattagcacatattccttaattttttccgattctgaataaatttttagatcaaaattccgcgcactaaaaaagggactagcaccttgttttcctaaaaaatcaagatcaagaacatggtaatcattttcgcggggcaaaagtgcttcggaactaaaattgattggttgaaaatcaagaaaaaaattttcttgattttttggtaaaggtgcatttaattctgactttgatattgatttctttgaaagcaaattgttttccatttttccatgagaacgatataaaaacgaagttattccataatcaagtacatgatttttgatcaattcaagaaaatcatcataaaaaagccgcttatttttaagatcctctggaattatattttcaacatcaagggcaaaaacctcaagtcgataattgtgatcttttaaaggtggcagaggcccaaaataaactccatcaggatgttcacgataaaattcatctagcaaataatttgttgcatgctttgtcattgaattttcaaattgatacattttttcaggtcgggcaaaggaatcatcccattttagcttattttttttaatatttgccgcaatccagtggataaaaacaaaacctaattcaccagtggcttcataatcaattaaggtgacagcataagattttgccgctttaattttatctcattttagcggaaaactaactgaattagggtacttttttcctaaattaccatttccaaatttagtatctagaaccccatttttaacatttttaatataaatttttatcataatagctacaagaaaatatttttcctatttttacaagttaaatttagtttaaaaaccctgtttaattatttagttttttgaattttttgggctaaatcttaattataataaccaaaaaattcaaaaaaaagacaagaaataaacaaaaaagcgcttgaccaaaaagtctaaatttaaaattattactgtttttgcgttctctttttattttttccttgttttttcttctactgagacaatttcgccatcctttaacgtaactataaatgaatttccgccggaagcacgcataaacttatcaacttgcagacgcggcgctatgtttaaaaccctcttaatttcagatcttcactgttgtcaggcagacgaacttctgactaaatgcggattcagctcggcataactttgttgccaaagataaattacatattctgcttgtttttcggtaatttgtgtttttggaaagctagctataaactttttcatttggtcagaattttttagtctatatttcgaaatccgatttttagcttcattgaaagctttttttatatcatctgattccctacccgtaggttgaacttttagaatttctaaatccctttcaatatccttaattattttattaacggcttcttggttagaatcaagaggtgtatgaatttgctggttattatgttgtttttcctttggtttttcatcctttttaacttcttttgggctttttataatttcttcttgctttttagtttcagcttttttattatctgattttttttcagttttttgaacaacattcaaattttcgttttttgttggttttcgagttaaaagctgtggagttaaaactgaaggaatagactgtttttcttgatcttttttctcattttttggagagctggatttttgaattacaatactaactggaggaatttttgggtttaaaaggtttttcactgatttatgttttttatcggtactgattttaggtggtattgccggttttgtttttggggtttgtttatctttaactttctcttgttctacaatgatgaattctttatctttttgtctctgagcagggttgttttctggagcttttttatctaaaatagctatttgaactgggttttttgtttcattttttgatggttcgggttttttaattttcgttattttttcttgcggtttttccctggtagaatcaacttcaattaaaattttcttgttttgacttggttttggagcgacttgtggtacaattttttcttgtttattagaaattataattgttgttggtttaagtttttctgggttttttgtttttttaattaatttttctggtataactattggtgttttttgaattttaggagcttgtttttcttcttgtttttcgggaatttgatttaaatcattaatctgtgaaggagaaaatggctcaaattgactttgaatttgtacattttccctgcttgtttttatttcgcctaaatttgatactgaatttcccgagacaaaataaaccgtagttcccactgaacctgcaacaattggagtcaaagatagggctcacttaaaagatcgacgcattttttttaaattaaattttccctttttttaatcattccctgcaaaaaattacataaaaacatattttttctatttatattataacatattatcactaaatattcaagctataaattaaaactttttgtttacttataaaaaatacctaaaaaaaataaatgttttgattttttttaggtatgattaatactataaataaaacaattggaagttttatcttttcaacctatcaaattcctcaaccttatcggatccaattatataataattgttatcgaatctgccgctcctcagaaattgggaatatctatcaaaaagcgaaaggcttgataaattattctcaagatttgcgggttgaaatggtaaaagtgtgccttttgttagaaaaccaccaatatcaattcgtctttgaacataaaatattttaggattatccggatcttgtttctttatttccttttctaattcgagcaaatttgcactataaaggccaccctgagaaaaatttgctgtatttttataatactcagtcggttcaaatttatgaattttatcgttaaacttgtatttataaaaatcattaacaagaccgatattttcaatcttttgtggttttggactaggaccttgaactatcggcggttttttttcttctttttcttgtttttcttctttttcttcttttggttgtggtttttgttgatcattattttttaatttactattatcataagcggcaaaattcaccggttttccataaaaattttgattttggggtaagtggggacctaattttggaagattcggttgctcttcaaaaggatcttttcggtttaaatctggattttgttctggttcaattgatttatcaccattatttatttcagaatctgggtttgaatcaacgattcaataaagacggtaaattgcgtttttaattttgttttctttctcatcggcaaaagttttatcatcaacaaagaaaaaagcgcgcggctgaaccttgtatttacggccatctttgcctattattgtaaatttttctagtcttgttattagttctaatttcttttggaaatctttgtcattaatcaaagggagtttcaaattatcagggtttgatatgtcatttatttcccttcttttttggagttctaattcctttaactgtctgtagttataatttcatcagtaggcatttgaaagtggttgggttgttgcctcgcgaatcgtatcgacaatccgggcaagcgcacccctagggattgggatctggatggcttgtttttcgtctttttgctctttttcatcattttgttctactacttgagcttctttgggttttgttttttcagaatttccttgagcactattagattctttattagcatcttcatcttcgctctggttctgggcttgactttgtcggtcattttcatcttgaccatcttgattttgcgggagattttttaaggcttgggctaggacattcggatcaatttggttgggcgaaattggaatattgttatttttttgttttgggaaaatctcattgagataaaattttgcataactacttactagtttataataaagataactttcatcaaggtcgatattatttactgaaaacccagctccataatcctgcataataaaatcgggatttgcctttaaattagtagattttaggtatttttcttgggaaggacgccatttttttaaaaattctgatgctgagagataagaagttccttgataattttttctgacatattcaggaaaatctggatctttagcaaattgttcaatttttttaaggattacatccttttgctcattatataaaaaacgctgaaataagagtggatttagtcctggatatatcaaggaatcttcataatattgactaataagagcggaaaaataatattcggcaatcagatttttttcaattgcaaggggaatttctagcatttcttttaagagttggtatttttctgttgcttctggatttgaaaaagttcttgtatttaggtcttcttttagaatagcatgatccgaacaagcagcagaaatcaacggaaaagtaaatgccggtaaaattaataaattttttataatttttttcatttttagttagcccgccttatttttatatataaaactataaaaaattgggttatgattttttatagttttataatattatttaaagataaataataccatattttttaaggaaaacaaccattttattcataaatttctttataacccattcttcttcaaaaaaatcctttaaattctttactaatttggttttttttaatatattcacgctgaaattcaaccattttttgatagtaattttttgaaaaaaatggaataattccttgataaattagctccaaagaacgtttatccagaacaattttgcattccttaaccggataaaaaacaaaaaaaccattatctgctttgtttttcaaggcgttttgatcaagataaaaatcaattcctcttaattttaaggcaatattgaaattataaaaattatgatcgccattaaaactaaaaattatttctttttggagaaggttgttattttcaactatttcagctaagcttttcccttttttaattacatatccggttaaccgtggggaaaaaattttccaaaaactaggaacaagtcaatagccatcaacaaaatgattaattttaactttttgaaaattgtttaaaaaactggctaaattagtcataacattttgctaaaaactcgggaatgccgtcttgatcattagatttagtaataaaagtcgctacttcttttaaactttgatcagcttgacccatcgcgactgaatatttggcaattgcaaacattggcaaatcgtttttggcatccccaaaaactatactgcggtcaaggttaagttgataattttgggctaaaaattttagaccctcacctttattagaaccctgagacataatatcgattactttttcttgggattgcacaaggtagatatcctcaattttttcaagttcagaacttgctttttgaaataacttaggatcagaatcaattttgataagcaaaaattttaccacatcaagcttttcaagttctttttttgttaattcctgatagtcataaaaggtaagtggtaatttttcggccttagaaaaatttttattctgcgatcttaaataagtaaatcaagaacttttttgatttttcttagaaaaagcaagcatttttgttgttgtatagactagaaaaactacttgatattttaaaagaatctcaaaaatttttccaaccttttcagggagaaaggtcttcttgaaaactacttcattttttttaaaatcgtaaatcagtgagccattgcaactaattactggatagtcaggtttgacttgataataatattttttaataaaatatcacggtcttcctgagcaaaaaataaattttttaggcttttcaaggccttgaagtcaatcaatgaaggcttttgttcgaaggctgatttcatgatctgaagttagtaaggtcccatcaagatcaaaaacgatattatcaatctgagctagtttatgaagatctttggggataatttgactactttttttgtccataataggcgttttttccgtgtttgcgctcataatgttttttttggagaataggatttgcttggttttggtaaggattaatcacttttgtataaaaagccattttggctacttcttcgaaagtcatagcaagtttaactgcatcctcagcagatttatttgaccaacaaaaaggaccatgttctttgactaaaacagctggagttccgatataatcaagcttgtttttttgaaagtgatcgaggataacaagcccggtattatgttcatattcaccttgaatttgttgatctgttagtgaatttgtacaaggaattgaaccatagaaattatctgcatgggttgtgcctaaggctggaatgtcttttccggcttgggctcaagccactgcaaagggcgaatgggtatggacgatggcttgaattcgtgaatcggctttgtagatcagtgaatgcgtgggagtatcacttgaagggtttagattagtttcaaggacattattttcaagatcaacaggaaccatatctgaaaactgcattttttcataaggaattccgctgggttttataacataataactgcgatctttgctaattgctgagacatttccccaggtatgaagtgctaatttggacctataaagtaaaagatttgcttctaagacagctttttggagttcttcaagttcgttacggtctttaattttcattagctaacctcaacttttcttgaaaaaattcacgggctgaacgaattatttcaacctgtttttgaaaattttgctcaaattcagcattttggtcaaaattttctggtttatgtcacatttcaattacaaatgggacattaatttctgcatttataatgtatttaaaagcagaaacaaaatcaacatcaccttggccaaaatcaagatttttgaaggtatcaggcaaggtatctttaaaatgaaaagcaataatttcacttttgccgagcttaatctcgacttcaagatcattggaaaaacgcgataaatttccaagatcgggatataaaaatactccgccaccgactgacttttgcaaatataaaagtcttgtgattgtcccggcgaattttctatccattgactcaaatgctattattatactatatttttttgctaatgcaacaatttttttcattgttttgatgaaaaaaatttccgaatttggatggggttcctcataataaatatcataagcggcaagttggataattgaaattccgagtttttttgctaaaattaaggctttttccataatttttagcgctttttcgcggatttttgcacttgcagaaccaaaaggaaactttcgatgtaaggacaaacacattgaatttatataaaaatcatgttcgattagagtatctaaaattactttaatctcatcattggaaaaatcaaggcgagaagcaaactcatctgtttcatcaactgacatttcgataaaattaaaaccagcttctttggcgattctaattttatcgattaacgaaaaacgtttatcaattgctttttcgtagataccgacaaaaaaattaggttcagtactttttaaactcatccttgaattcctttgcttttgcctctggatcttttgcatcacgaattgaacggccggcgataaaaatataaattgggatatccttaaataatttaatatcctcaacttcaaccccgccggtgattgtaaccttaaaacctaaattagcaagttttttgacaatatcaatatctttttgggctcattttaccccggaagcttgcgaatcacgtggtctgtgtcagactacttgcggaactcctacttcttttcagtcagatacttgatctcaagcaaaattatttgtcatttcgacttgaatttcagtggttttgccatttttttggtaatatttttttgaaagatcaactaaatccttaattgtcgctgtttcggctgcacaaattacagtggtaaaatcagcgcctgcttcgaaaaacattttcccgaaaatatttccggcatccgcaattttaccatctgctactatgattttatcaggaaatgcttttcttaattccgaaattgcttttttaccttccgaagctaacaaaattgttccaacttcgataatatcaatgtacttttctgccttttttgccgactcgattgcctcctgaatactctgattgtcaagggcgatttgcaagagcgggactgccatttctctccttttcacgatttttttgttggtttttgtgatagtaattatacactaaaattgaatttttccaagaaaaaaattcaaaaaaattcggaaatttctttgcgaattttgcagggaaaatgaccaaaaaattaattaaaaatcaggcctaaattctctaaaaaagtccaattttttttaaaaattggtaaaaaattgccttgttttggcaatttttcaaaattttaactaaattttagctagtcacacaacgtagttttggctatattttttaaaaaaaacaagagaaaacggggttataagcagaaaaattatttcttatttgttttaacttcaactggtaaaccttctaaattagaaccaagttggggaaaaagcgaggaatcaataactatttttgaaaaagcactgcttcgttttgcgactttaaggaaattaatcagatcggatttagccgcctcagaataatttccatttaaaactaaagttgcattttgaacttgtttaccggatttatcttttaactcaattatggaaaattcatgaggtccaaaatttaaccttttaccaaactgaccatcaaagtcttctagtttaaccgtgtattttttctcggagctagaattagttgaatcagtctgggaatcttcatcaattccaaatgaaagattcttgaatttaaggtaaaaatttgcttgctctttaattccggtatcagtttcccaagttgaaatttcatcattaaaatatttatttgtcccatcgaagtcaataccttttagagttttaatacttgttttactaaaatctaaatttggcggataaccacctcgcccgccaaaatatccctggaaaactcgttggttgatttttgaaccaaaggcaatttttagaccttcgttaattttgtttggatctgattgatctttggatcaagttagagtatcaaaacggattgaaccaggcaattttagggcgggattataaagttttatattgggtttatcaacataatctcatttaacaaaatcgacattttttagcgcatttggattaattgctcaggctccatcgtcattttgacgatttgaataaagggataattctaataatttatgattttcaagttttgataaagctaaaagtccttcaggatcttcgacaaaaagccgtagggaaagaattttttttggtaattttgcaattatactttcaattgttgaagaatattcacctttgacattttcaaagacaacctcttttagatcttgttgggttttttcaagactttcaagaattgaagaaaatttggaaagcgcatttgaatcggaagcatcaaggactagcgaagaaaaactattataatttccttgaaccgggaggttattttctttttctttttgatactggataagtttgatcccggaagaaacaccttgggattgaaatgatttaacttgttccgaatttgcatctaaaactgttttagtccatccctggcgtcttagcgaacttaatactgttgagtcattattttctcaggaactaccataaggagcgataccactggcattgtttttaattactgatcttctataccagtcgtttttaggaatccaaccatccgagtcgggatcaggactataaccttgctctaaaaatccgaattcaatttgatcaagttcacctctttggagacgagcaagtcggttattatgatgttttaaatcttggttttggcgatctagttggtgttgttcaagggaaatttcatagttaataattttatctcagtcttttcccttatggattttctcgtctcaataaaccgatttttctttttgctcacgttgaaaatttagatcttcgatatgttgttcaatccgatttttttcggtagtacgtgcactaatattatatcgtgttctttgaatcagagtttggattgccgaaccatattttcccgaaagatcaacgcgttgatattcatctttttttgggataggagcgttttgtcttggtcttgtaattattggctcttcttttggtagtaccgtttgtgctcctgctggggctggttgatttttgcttaagtcagatttgggcggattaggtaggatagtgggggctataattattgcagcggtttcgtttttttttgatttggatttttcttcaaggtttatctctggttttagatcagtttttttaacagtcgggatttcgggaatataaactggttttttttcagtttctgaaggtggagttggttttggggcttcaggtacttccttttttggaggaggctggatataatcggtattagcgactggggaaaaattatctgtatttgggttattttttaaaataatcgaaggagaaattgtaagatactgaattccgtatttgctttgataatcttgtttataataagctcctgaagttccaattgccgataacaaaagtccaaaagttagtgaaattaagatcagccttttccgtcgcgttagataaatagccattttcttccttaaaatttaaagtaaaataaattatagcaaaaaaaaaaaaaaaaaaaagaagtaaaaatttaaaaatttattctagaataaattcaaggggaatctcgcctttgatcgtttgtctttgaaagtttgaaaattggagactttgactatttggttctaaatatgcatttggctctaaatgtgcatattcaagatcaaaactatataataattttttatctttaatttccatttgcattttattggcgtttttatataattctgttcatttaagcgagattatttgtggataggcaaaaaagttattattgactttgatatatttatttacctgaaattccttaaggatgatatcagaatcattattttttagacggaaaactaaattatccagtaaaatttttccaatttgccctttttggatctcagttagactctgaccattttgattctcgcggaaaatttttttatcacgaatttggggccaaataaggtttggatcaatttggaattcaaagtcagaatctccatttttcttaagattttcaaaagtaaattcctcgggttggccgatattttgctttgtctcttcagtttttgttttttgaactttaagttttagtatcccagtttgatcatttgcacttgcgctaagaatatcaaaagatcatttttcgagatcctttgcattttttagacctaaaaattcagttttaagaccaacggaaagtgaaacctgagaaaatgcagcactaaaatcactaaaaactggaagattaaaataggattgcttcccagaatttacaagtgcataagctaaaattgaaggactaattttcgaaaaaaccggtgaaagttgttttttatataagatagcttctgttttttctagttttgatccttggtctaagtttcaaaaaaggacaacatcttttgttaattttagatccattcctttttttagtaatgaaagttggacattttcaagtttatgttcgtttatattacttgaagaatcgacttttttaacttctcaagggaagttaaaaattatttgataattattatcatcgaaattttcgagtttttttataaaatttgtatagtgaaaagttgatggtttttctttgagacgatataaaagtgttgtaatgttattattagaaaattttttttcggttggagatagttctaaaaaatcaggaattttagcaaattccttctctaattcttgtttatcttgtagaatttttttattttcctttagtagagcatcttgtttttcttttgcttgcttggatttttcaagttcaaagctaattttttcaagtgcaagtttttccttttcaaggacaagtttttcttgttctgcttttctaagttcttgttcctgtttttgtttttgctcttcaaaattgtccttttggatctctagtttttgatcggctaaattatgttttaattggtcgattttttgatcaactatttcttctttttttataatttctttagtttttgtttttattttgataatatcctggacttgttttggctttttactaacctcaaattctccaagatcaacttgttctttcttattttcttggaatttacttgagcttgtttgatctgaactagatacctgaccagatttatttaatagattctggttatttctggtttggctggattttgctatcacttgttctaaatttggattttcctgagtttcccagtttgatggcgaaaattcactttttagtgaatatgaatatgcagaaatcgccgtaaatcggtgttttttacccgtaaaaccttaatttttattaattacaattaattacaattttaaagtaattttatggtataattataaattatgaaaaagcataatttgattttgtttaatgtttgaggatcttcaaaagataaaatatataaatatgttggctgaacacaaggttatgggaaagctccaaaacgttgatttagtataggaaatgtgcaaactttggaaaaaattaatccaaatgctattcaaattatcaaagaaaaattgaaattattttcaaatttagatgacaaagataaaatcaagacaactttacttgattctattaaaaattccgccataatcgaaggttcggtttttattggtggggaattaattgaaaaacttattgaaaagcacaatatttttgaatcacttcctaaaagtagacataaaaatatgagacaaatttttaactacttaatttcaaagcgaattactgatcctggtagcattattaatgcttttgataaaaaggatgattactcaaatcaaataaatacttccaaaaatagcttttatagactcttagatcttgtctatgaatcacaaaatcaacttttagatagtcttaacaaaatggttataagcgagcttggaaaaagggacaatgaattttattttgattcatcaacagtctattttgagacatttgaaagaaatggattaggaattcctggctattctaaagatgctaaattcaaagaagatcaaattgtcattgctttagcatgcgataaaaatggcattccttttcatattaaagtttttaaaggaaatacagccgattctagtaccctaatcccttttgtattagatattgaatctaaatataatatcaaaaatatgacaataattgctgaccgtggcatgtccactgctgcaaatattcgatttcttgaatcaaaagaatataatttcattatttcttatcgtgcaaagataggcagtcaaaaatttaaaaattatttattagatcctagcgattatgttgatctaaatacagattttaagtataaaaaagaagaattttattcatcttataaaaataaaagatacactgaaaatattagaagaagaattattacttacagtagaaaaagagcaataaaagacagcaaggctcgcgaagagcaaatccaaagttttattaaaaaacaaaataaagatggttttattgaagtaaacaaattgtttggtaaaaaacctaaatattttagggaaatttcaaacatgaaatttgaattagatcaaagtaaaattgacaaggacaaacaatttgatggttactatgtctatgaaacaaatatactaaatttaaatgtcttagacatagttgaaaaataccaaaaacagtgaaatattgaagctaattttagaagtctaaaaggtttattgaatattcgtcctgtatttttaagaatagatgagcatatcctagctcatacatttttgtgctttatctcattagttattttaaaaactataatttttaaaatcaacaaacatattagtgataacaagttatttgcaaacagtcaattaactgaagttggtttagtaacgatgttgcaaaaattaagacaaagggttgaatttaacactttagatcaacaaatgatatttaaaaatcgcgatggtgttcctagcgatcccaatatttgaaataggtatgatttctactttgatatcttaataaatcagtaaaaaaataggtaattaacttttggcaaaaaacttaaaaaagcgcgggaaaccggacacttttttaaaattatctcatcaaactgggaaactcgggttctaaatttggattttttgttgttaaatcctcaggctttttacaagctgcggcaacaaaaaacaacgggataaacaaaagaattatccctaaaagtcaaaatttaaaactaaatctcccgacttttgctttcatcatcccaccccttaaatttcgtagatgaaattataacataaattttttgttctacaagaaaaattctaaatttttttggagcacggcaaatccgagttttttttgatcgctttacgtaaactaataaaaaaatcaaaatctcaaaatttagtactaagattttgatttttataaaatttttgtcaaattttttcaaaaattatttttgacttgaaggttgatcctcgctctgtggcggctgattttgataataaaatctgataatttcactagctagatcaaccttaccatcacggaataaaatcccaattgttaactggctcgataaattattttggtcataataaagttttttctgattatcggataagacaatcatctggttcataaaaactagttcaccattttcattaaataccccagaacctgaggctcctggcccattagcagtaaaaaatcttggcatcccattaacaacataaacacctttaaaaatatttttactaaaagcaagttgcggtcaaaaaccagcaattttggtgctatagtcaatatctccatcctttcagattctaccattaatttttaaaggactaaatgtttttgcataatcccagaattcttcaaaagttttaaattgttcgcgaaaaaagagaattggactatcaattgtagcaccattagcaaaacggaatgttgagattaaagattctttatgtcgatcatagaaagcaagaacatctttgatatcttgacgaaatagtccgtggttaaaataaaacattcctatatcacggccataattattaaatccttgagctagtctaaaccaacgattatggagattaatactaaaattaattatttcttcttgacttgcatccctaattgggatatttcttttttcaccttcagtaaaatttcctttagtctgaagttcgtgaacagtgcgatcatattcagattttattcagaaaagggataaaagcccggaaaatccaagagaagatagatcatttaccttatcattataataaaaccgcataaaaggataacccattctttctcagaatgggcgcccattataatataaaacatgagcgtttgttaagaatagactctcaccatctttattatctagtaaaattgccgttcctggggaaaaacgaatattacgttgaaaagtttgttgatatttttgatctgtataatcaagtgatttaaagccgatataatttagtgggaaataacgctggcgaaaatcttcattataataactatgataagcaatttttgctaaatcgttatttgttacattctcttttttgattttatcaaataagtaaatatttagatcttcgtttttttgacctaaaaacatattttcgttttcttgtttgattccctcaggggatccaagataaaaagattggtaaatacttggaaaattaccaaaactagaatcaaaaccaactttttgaacaactttttgatcaggactacttaattcctcaaccttaaattcattttgtgatttttggttaattttgcgaaattcctcttcatcttggagattaattaacgaatcctgcccgcctagtaatgaattaagacctgaaaaatcaagtttttctcctaatgaagtattattactaggattttcaattaaattatcaactgcaattgtgtcttttgacttaccagaattatcagattctggactttttggagcagcatcaagtaaatccgcgccccttagcatcggattatttaaaggattttctagatccccttcgtgattaaaaggtttttttgaaaaatcgagattctcatctgccttatttttttcggattcagggttttctttttttgtgcttggtaaagttaaattatccccatctttgcgaggttggttttgaggttggttttgaggttggttttgaggttggttttcttgcttcttggttgtaatctctgtcttatcgtagcaagaaagaacacccaagggcaaaaaagacacaatcaatcaataaaagaaacgtcaaattttcatgatccacccccgacttaaaataacttggctatgtatgctggcattataccatagataaattaaaaaccaaaaaaaattttttctaaaaaagaaattaactacctatcaaaaccaaaaaactagttctagctagtttttcggaattagtattatttttacctatggtattttttgtccacctgtgtttctcgctttttgtttttaattctgtacttatcgtaggaagaaagaacactcgagggctaaaaagacaaaatcaatcaataaaaaaacgttaaatttttatgatccacctgcgacttaaattaaaataacttagatatgtatgttggcattataccatagataaattaaaaaacaaaaaaagtttttctaaaagactaaaactattattaatcacctatcaaatccaaaaaactatttctagctagttttttgattaggttatttcgtttactagatttactatatagttaaaacaagcttaatttgatatttgcaaattgtgctggaagcaattgcgttctgtggattattttgagcttgtttttcggtgattttgggtgcactattggttttttttttttttttttttttcgttgttccctgggttatgaaattgccacccgttattggtctttgtactgatacttggttgttatctcctagtgagtgttccgactttgtttttgtttacttattttgttttttattgatcgctttttatgttttcttgtgctgagaacgcattccctaatgattggcacctgcttctcgtcctacttactcgtctccatcatcgtcgtagtaatccgatagttctgggggattgactgggttaaagacttggtaataattgtctggactatataggaatggtagatagttgctcccttctttgactaggagtgctactggtcatcgttcgttttttacccctgttcacttaatcttggggccgcgagttctgccgtcgtttattaattcactcttgcctaccttgagcttattttttgcttttccattgatataaattgctgctatttttcttgtcgttgttacaagagattctccatggtaatcgaacatataacctgaggttgttttggttgggtttttagcatttaggtatcaggtatcgtttcttagctcgtccttaaaggcaaactcgaaccccggtgctgatcagaagagctcttcgtttattttggttcggtttattacccaggactccgggattagttttgcttcttcttctctccacttgttgtttcattctactccatttgtgggtagtgatatcgcatcatgggggtttgcgtgatgcgtttggggcattacaaagcctgggaggtttggtgtggggttttctgcattgatcgatattgcacttgcgatagtgttttctgacttttgtttaatccttagcctgatagggagtttagatattgaatttggtttgaaggcgatttttttacccatcagacttgtgggaagcctatatttgccttggtcgacgttaatatttcaatatagggttacgtatcttatttttttatctttttctggggttggctctttctgtttacggcttgttctaatcgctacgggtgggcctgttatttgaatttcttcgatcttacctgcaagatttggtagtctttgatcccactctttacccttggcttgttgttctttgggttcttgttctgttttatcccagagcacctcaagtcaatcttgatccctatatggggttaggtctgcgaactctccatatggatttcattcggatccagtcggcattatctgatctaaaggatcatatactgcataggtaaatcccattagtcctggcattatataatcaatatgcattggtgttactgttgcaattgtggtagaagactgaaaggaaatacttgaacctggtatttgggattgttgggtttgcagttgttgttgggaggattgaaaggacccatccacggtcattgggttggagttaaatttttcggggtttttgatctctacggttatgctggctccgattagggtttttagggtatatggctggaggtcagccgaggctatttggagttcggggtttcaatttcattcttttagcaccgcttttccatttatttccgttccgtttatctttaccttgaggttgttttgtaatcatttcggtcctattgtcgttactgcttctggattaaactggactttgactttttcacctctgtaaaccttatatgaaattggtatcgttcaccctcttattaactgtgggcgtatattttgaggggcaaatagtatttcgacgctgcggccgtgttttgtgttttggtctatgccctccagggttatatctttgatattttttaacatcgtttcatttaacttaagctctttttgttcgtctaattggtggtttggaatgtcttgcctgtttttgggtaaaattttaactattttatatatacttccggattcaagatttgaaagagcaaaggttagctttgaatttgctaggttaacaccaaccggttcagattcaagctcttgctcgttataagcaagattgtattttggtcctacttttttatattttaagatcattgggatcccttgtaatgattttgcatcttgaacacccattgtaacctcaattattacttgggttggggatactggagttattttaaccggattagatctacttaggtttaaatatttagctgttgtccgaaactctctttcgtttttacgacccccattaattattaaattatcgaattctactttaaggttattctgtagtgatttaattttttgtgcctggctacttttttttagaattaaatttatatctgtgtactttgtaaatttaataaggtccttttcctgagccttgaatttgtttttcttcccttcttgttgctgtcattcgatcgtccttgtataactttgactttccccttctttttttacttggagttctgtatcaaaacctgcttttgtaagatcatcagttcagccctctaatgtaactgttgctgtatcatcctcaggatctgtagttacctttgtaattaaaggctcggtaataaattcaagatcgacggttttttgacttgtcgatctttttttacgtctggtttgatttcttttccaccccttgactaaatcaacttcacctttgtgggtatttttatcaactgttaaatttactgttttggatgtaagtgcttttattgtataccaaattccaggtctaagagtattatcaaacttgaatgttgcttttagttctttttggccatttgatggggctgaaataaatgttgttgagcctattgattttacttgttgtcctgattctgaattttcaagatataaggtgattgtctccccttttaaaaaagcatcatcttcggcaaatgtaagttcaatatctgcagaattagttgttacatttgtaattgtcgatgaagtaagatttgctttatctgctcttgaataaaaacgtctttggattgcactttcatcttttattggatcatcaaaagttaattgtctaccaccattattaattcttttaattatatattctttaccttttttaattgtagattttacttgaaaatttattgtattatttttcttaccatcttttctttcccctaccttatttctagatgttgttctcattgcttctttgttttttagttttcaagattcagggatatatttattaccaaagttttcatctatttctgaactaagggtaagtcgttttccatcaagaagaccgttgttattaaaaagttcaacaaaaacatttgtctgaccttcacggattgcttcatatttaattgatttgattgcattttcggttaaaaggttataattagttctttttggttttgcccttaaattctgcggcaggctaacggcaaatttgtcggccatttctggttttaaagtaaaaatataattcttgattgtatatctatccccaggagttaaatttttagcttccagttggactttgattgtactactacttttactatctttaatttcgactgtatttgtataaaaaacatccttatcaactgattcaagctcaagttgaattttatatttatcttttaaaaatcctagatcttttttggcaaattcaacttcaaatcaaccttgtctgagctcggcctttctattttggttttcttgcctactattttttgttacagccatttgatctgttgttgaagtttttacattctcaattgaggctgactcaattgatgtattaataattgttggccatttttcggctgtatcggtttttaatttattactatctttttcccagtcagccttatcaataaataagtcaaaatcaccttgttggccatttacattttttagtttaacactatcaattaaataccaacttcctttatcaaggcctgtaagttcaacttcaagacgagttagggttgaatcatcattttttgactttgttattagtatttgttcgttttttacctcttttgcactaacttggagttcagaagaagtcttagccattttatcaataggatcactagggttttgccagccatattcttgatatttattttttaattttttatattttatttccatttttgaattttcaaaagttaatttttgtgagttttcaacatcaaaaattaactttattgaattctcgcgggctacataagctagtttggtaattaaaggggccgtgttaaaattaaatgaaggagtattttgtgggcttgaagaagaaaaaagtgaagtagtaatcccattttcattaggtacatttattctaattttttgttggggatctaaaagcccgattacttgatactttgcccctggatcaagtccttcaaggtcaaattcataatagaaattagcctgatctgggagattattcttccagctttgctgttcagttctaaactgatcggcactaaaaatttgagcctcaacttctttctgccctgttgttgatattccgtattttgatgattggtagacaagttttagttttgtttgtttgtcttttagaggtttatcttctgaaccaaaaaagactctaacttttgctttattccatggggttggactagaatttgatcgatcaggttgatagatcaccccaagggcgtttgccgataaaaaatcggttttgaattttttaacttcttgagccgaactaggttgactacttaattgacttgctttggcagtttcaagaacctttatatcattaaattcgatgttttggggggtttttagctgactttgatttccttgatcttctttttcaaattcgattttattaattgtataatcacttgctttagcaagtccttttaaaaggaaaactgcttttgaagtttttccaatctcatccccgacaatttcagcacttgcactagtctcagaatttgaagaacttacttgactattttcaagcttaaaacttccttttacttttttcccgatataagatccataaggatcgtcaattacaatttcaattgttgcagtagtttccccgatatatttttttctaattgatacaacttgggagtttgtataaaatgatcgctgcgaaattgtaattgattctttaatgcttacaggaggaagctcaagatgggaaattgctttgatagttttagttttttcatcaaggaatttaatatgatcgattatatattttcctggctgagaaatgtttttgatttcaacttcaacttttgggttctgcccattttgtttttgaagggttgcagttatattgtttttatcaatttggacttcttcaaaaagaccttttggatttttatagacattgccattttattataaacctctaaaaatccttggtatttcttagcaaattcaagtacaactttggctgaatctttcttaaaatcgggtttgatctcgattttatcaacttcaactttatccgggaaagtaataaatgctctttttggattagcttgttgactaaagcggaaaaatcctgatgtatctgaatttatctgttgagcttcttctttttgaattacactgtcaacattagtttggtcataggcgattttttcaatataatactgggcaaaaagatcaagatctttaagggtaaatttaaaagtagttgaattttcaagactactttgatcggatttagctgaagaacttgtactttgaggtctttgggctaattttttaatttcagcttcaacttcttcaatagttgccttagcgtttttcccaccgacaacttttttatattgaattttagcttttaaagaagttttatttttaaatacttccccaccatctttaagactaaaaataaaatcatattgatttggatttagcccattacgaaactgctgaattgaattaataattggaagagttgcaaactggcgggcatcatttttgactttagcaccatcaaagtagaaattaattttttgaatccctgaagtcgtagttgatcttcttaatcttcttgcagaatttagttcatttttgagcccaacaatatgaaagccatttccgccttgaagcgatctaagctcagctttaaatttaatttcatttgagctttgactatcctggcttaattcaacctctttttcttgagaatcaccgacttgataatagacaagttttaatttatttttataatcattatgttttagatattgatcttttgcatcaaaggttagcgtaattgttgcctgatcattttttttatcatctttttcaatttttataattttagcactttcaggataaattataaaatttgacccaaaggcgattttcccgttattggtgatctcgccttcaatttttgaatgggtttttgtatcaatttctttgattgcaaaatcagaaaaattagggttattttggctagtagaattttgattttttacagttggatcgactttgtttgtttgtgaaccattttgctgactttcagaatcagctcaggtaagtgattctaacttataagttgcatttttttcaagatcactaaattcaaaactaattttggaattattggcttttgctgaaaattcaagatcacgactctggggattatttgttccatcgccagctaatattttcttaagtctaatttttatatctctgtcttcaaatccaccggcttcaattcctcttccagcaaggggatcgacaatatcaaagttagcaatataagttgtctcgtcttttttagtaattgaataagaaatcacttcgggcttggttgcaaaatataattttgaaagtaccttagggggattttcctcttttttctttttagatccagcatcttcatcatcgaatttaaaaattcttagttttttaggcccttgtccatcacttacatcttcaattttgacaagcagatataatgccccggcctcaagttgggaagaagcatctaatctaagatctagttgtggatttgtattttgactagaacctgtagtaaattctttttcaatacttacttgctttccggtaattgaatgtttaaatgtaaatcttaatttgcgtttcttaccatgtttttcctttgtcaggaaagtttcttttttatcgaatttaatttgaatatccgctgaattattatctgattgataagctatatcaacaattgttgccgattcagcttcaagttcaaagtttttgatgattttggtttgggacttttgatgactagaaaacccttcaatttcattaccacttgcattacttgcagttatttgctcttggggttgttctgctacttttgcttcagtaattttataactagcggctttttggagcccgttaatttcaaaaatagcaagtccgtttataatctgggcggtataaaccttattttggttagaattaggaagctgggctccgttttcgccttctagtttaatttgaagatattttgaatttcaatttgcccctttatcatttaatttaattgtaattcttgctgaagtctctgaagtagactctgggctaatctcggcaagattaggggtaggtgagaaaaattgtttttcaaatcctgcttgggtattcggggatttatcaaattcgaatttaaattcatttttcttaagattttgttggtttcgaactgaaactgtttcattttttagttttaaagactcaatttcgtatttatccccgggatttaaattgttaagggaaaaactaattgttttattattgacatcaactttggcttcttgtattgaaactgaagattttgttgataaattattataagttaattcaatatctttttggcctaaataatcatctaaattatcaaaagttaatttaatagttagactatttgttgttattgattcatattcgattttattgattttggcagtctgggcgcttgtaataaatgttttttttggctcaagatttttactttcgacttcaaaaagttcaatttcttcttcttggacttgctcagcttggacattgacaaaaacggcattaaattcggatatatttgatctaaaaggattctggctagctaaaagtgaacgggcttttcttacttttggctgatttgcttgtttttcaaattttactgatttaattttatattttgcaagcttatcaagattgataaaagtaaaattataaattccattaagggagacttgctcaagtcttaggtttgaatttgatccatttgaattttgaacttgcccattttcgccgatcttttcaatttcaagtgtgacttttttcccggcggtataccttccgccatcttttagttcaagatgaaccttggcttgacgctcaactgaagtatcaatttctaattttttaataaccgctgaagtagcaattatttgatctttataaaaatcaagatcatcaagataaatattaacttttggatgctttggatcgtcttgttttacttgttcaaaacctaaaatgatatattgttgtccattttcaagatttttaagtttaaaattagttttttgggatactatatttgtctctgcttgaacgatttgttcttgactttcaccgccgaattttttatatctaacttttagtttttgactatctaagaaatcatcaagtttttctgtattttgactgtctttgttatttgttctaagaaaatcacggccgaattcaatttcgaattctgcttcattttttgttctttttgtcagattaagacttgttatattagctgtttttgggattgtagaaaactgttttttctcatttgtagcaagtaattttgctttaaaagggattgttttggcttgagtctgacttgtctggaaggttgagacttgatttgggctagttaaagaaagcgatctttttgccctttttgggctagcagaaggtgtatcaagaatttctaaagaattttcatttatttcataaattccttgtttataaagatcggtaatatcaaatctaattctagcaccaacaattggggcggtgatctccccttgttttgcttgggctgaacttgctttttgtctatcaccgtttttttcaactaaggtatatttaagtttggcagtttttccattatattcgcctttggcatcagcaagaataaaggttgcgatcaccctttgttcataagaattatcataaccgacttcaataattgcgcttttggtataaaaatattgttgcttagcatcaaatttatttgtaaaatcaccaaaaagcatattcctttcaattatctcttcctcgccattaagaccaagaattttgcgggctaaaacaatcgaattaatattatattttgatccaatctctaaatttgaaagactaaattctaaagtattttgattattatcttttgcgccttgtgaattttgtccaatttttgtagtagttgataataattttgatgatcctgcaagggaataataaagttttacctcattatttccaattgccttataagtttcaggggtaaaatcaactttaagtttggcacttgtttgttcttcttgcaggttgttaattgattttataactaaaggagcatgaactccaaaaattctttgggcctgactaattgtttttgaaactggaagaatatcatttgaaccttttgaagatttataattatcaatctcgattgcttcaatttgatagtcaagtcctttttcaagattttcaattaaaagcgaggaaataaccgtatttgactcaatttgggccttaattgtttttgtagtgccccctggttttaattctttatatttaattgttgctgattttaaaggttcaagggcgtttttaattgcaatatttaaggcaatttcagtctcagattttttaatataagtaattgaagatattgccggacgagttgtccaatttagttggtcagcataaatattaggcccaaaatttagatataatttattaacaaattcttgattattatcagcaatcccaattgagtcaataaaataattagttcctggttctaaattaattagatctcaggcaagtacaagtttatttcctgagatattaaaagcacgggcctcggatttaattagattagttgatccggcaactttaaaatataaagttgcaattttatctttgataaaatcatcagctgaatctagaacaacgctaattcgacttgaatcttcactgattttatcaattgtaattccctcaatttgggcactagttgcatgggtaaaaaattttttttcttttggatcgaaattttttgaaaaaaagattgtacttgttggttgttgactactttcttggtcaaaattagtaatattacctaaaatctcaaaggaagcaattgtaaaatgtttttctttttcaagatttttggcaaatgaaagcattttattcccgataacctgaccaactgttgaaagcatcttagagggtttatcatcggcaaaaaaattaatttttatatcttttccattaagtaaaagactttgatcgttgaatttaacatcaaaactagaagtattattgccatcaacaaaagttttaattcgggcaacctcaggggaagaaataaaccagagttttttatcaacacgaaaggaaagactaccagaattattccagattcttgaaattcagaatttagccccaccaggaatatcgcttagatcaagattggcataaacttttgatccttgaatgattagatcaacatcatttgcaagtccaaattggtaattatcactctcatcttttcaataatattcaagatttattttttcattattattaagttttactttttttgaatcaagaactaaactaatctcaacaagggcggaattaagtccataagctttttggcttaaactttcaattttccctgaaatcggacttggtctaaaaaaccgattggctaaaggcgagatttcaagatcaaaaagcgaatttggattatcaaaataatattttagatcaacaatttcatagttttgaccgcggacaagattattaaaactaaataaggcgttttttcttttatcccctttgatttgtccattagctgttaaaatcttatttgttcctacttgtttataataaaggattaaattcgcttcttctaaaagattttgactatcttcaaggtcaagatctaaaattgttgtattatcaagatcataataactaaatttttcaacttgatttttcgttgagaaaaactgggaagtttttagaaaactaaaataataacgcggattattcgggcttacaagttgaacttgataaatcgaaccgggtaagagactatcaatataagtcgaaaaattatctaattcttgattatagactatttttgattttacctgatattttgatttttgattaatatagacaagttcaagatcagcatttttagcccaagatgtatcagcctgattttttccttgaagtttaaaactaaattcacctgttgctgcctgaatattattaccaacaaattcagtgacataaatagtttttggacttagtaattttgcaagataaggggatagagctataattgatccggttataaatccagatgcagctagtaatttcttatttagatatgaatttagttttttatcatttcttacttcgtttttctttgccattttcttcctttcaagttaatttactattgagatatacccgtccaaaaaatcgtgttgctaaaccctattttttggtttttaattatgctttggctttaggttatactgttattacttttcatatgtcttctcttcggacccaggttatgacatatggtgtttccgcgtcaactgtcatgctgttatcgttatacattggtagtatgtatttgtggttgttgatctctttatagtatttgtcttttgtatatttggtgtgcgttttctgtcgtagtcaggggttttggtttgggttaggtggtaggtgtggaaagactaggattccgaggaatttgagttgctcgcctggttttgggctatgtaaagggtcggttgacgaactttgtaacttaagtttgattgttatttttccgttggttaattgctgggaaaagtcagcatctcgccataatattattggtaagccgatttcatttcgtattagatacatatcaccttggttatttataaatcaaccatacatgacagaaggcattacttcttggacgaatttaacttgttggccttggttggtttttgtatataaaccaacggtcattgtctttgaattttggtcgtattggacatcataaataccaaagggtttttggctcatttgcttttgcttttggctggtttggagttgtatatttctatctacctctggttcttgaccgtttgcgctggtttttttaactctagatgatgggcctatgaatattgtattatctcagtttattccggtgagtctatctaatttggaactaaacgtgtttgatctagataaccctcgagcttggttagtaaatatatttcctcagaatggatctgttttatctacttggggatatgtagcccctgtaaggaaaaccttgggttcgtttcagggtgtaaggatttgattttggtagtagtttttgattgcttctgttgtttgaaaaccgattctatatcggtggctttttgagttatccctgtggttttggggttgcttgtatgttatgaatcatcctaattcgacctcgtttggatttgatttgcgcttttttgtagttctctgttttgtttcccattgccttgctcagtttaccttggttttactcttttcctcgtttttggttcattttactttcttttcaattttatttactagttcacttcattttttatttgggtctgtgagtaacgaggaaaattcgttattaattttgtagcctgatcaacttaatgttaaactaacatttgatttgtttgattcgggtccaagactttggacggcttgattatagttactttggtccgctatacttttactgatgttttcttcgaatttatccctgataaaatccgctttaactttattttggttttttcttaccttgcgtggatcatagagttttgcttttattttgatccccactcctgatacaatctcggaactggtttctcttataaatgctacgttggttttttgttttcagttctcaatttttattaatgttccattactgtagactcttattgggaatctggagtccttgcgtttatctttttcgttactctctgctgagggcatagtgattctttcttcttccgtcacggggttggtttgttgttgggactgactggcgctttgattttccgtttgatgatcatatcagcttgttggtgttgatggtgagcttctatcgggtttccggaaataatatgctcttaactctagactaatagattcattttcaattcagctaccatctcctttaagggttcatttaaagtaacgatagggtgacgggtcgaggattggggatttcggagtaactgatgttgtttgggggccactattgttagaggaaaaaacctgattggattttttagatttcaactgatagtaataggggattttgttcattccgcccatctcctttaataagcggtttatgtcttctgactctgttatgtatacatttttattattatttcctaatactttggtttgctctattttgttttggtgttcaacgttttggttaattgtttcatgggggtttatatagggtatgtattcattattagttacttcggcaactctatcgatccttcatttttctgttgattgtggactgtcgagcgttttgagatattttttgactagtttattattattattattattattattattatatagagcaaagtttcattgttctagttttgtttcatctagtacttttcacgggtcataaaattttaatattagtgattgctctcaggtatcattacgcccttcgggatttgaaaaatctgtcattctaattgtatgaagatctggttcttcaatttgggttgtaaaagttaatttattactatcgttattttctaaatttagggaagggccattatttgattcaatttttgttataacatatttagttgatgctcttagttgctttcatctgttctttttggatcattctcctagatccgttacttttttatttgtaagcgaagccgttaacgtttttttggacctgtcaaattttaaagcaaacggtagggtaacttttttatctttttcatactgatcggctgactcaagtgtgatcattaaattttgttgcattttgttttggtcgccacttttatttaacgctcacatatatactggatccaagtcgatatcaatattttcttcattgtaattatctgtgtcctgctcgttttgtcaaagcccggctcagggttgctgtgttaatttaattttatcctgaggtagtttatcaaaaggcatttggaattctttttccttttgctggatattggagggttgtgttgtttgcatttgcttactaaagttgatccgcttattatttccgaaaggaatatcataaacccctcattttattttatcaatcttgtatttaaggaatggaattagtccattaaattgatatttgaccttaattgtatttccagttgaactttctaattggccaacctttgatattttttttgtctcaaaaggaagaaagctttttgcttctttatcagggtctggttctattgttataacaattggggttttttctagatctttaaatgcatttttatttcctacaagttcgacttcgagttcagcatctgtatcagaactagcagttacttttattactttgactactggcggaattcttacctgtttttctaatttaggtgtattggctagattatattggtttttagggaagtcaaccttaactttgatatttttctttttacttactagagatttaagcttgttattttctttaatttcaagttcgaattcgattttttgacccggttttagtttcctctgggcgcttttttcttttgttgtatcaagattaatctttaagacataaggtgttgctttgtttgtattatctgagctgacctgaaggttagttttttcaactaatacttgtgaacctgagacttggttatcaacctcttttattttgacatcgattttcgagctattaatccaggcatcattcttatcaaaataaagatttacatacccttttacttcttcaccttcttctggacctgaactactactactactactactactactactactatgactcgatgaacttcctgttcttacattaacttgtttaacatcggcaacaaaaattttctggattataggggtaaactcgctttttgtttggctaagtgatcttttacgtcttgttctcacttgtgtattcaaatcagggatctcaaccccaccaatttcaagttttttaatttcataggtctcaaatctatcaagatgttcaagacgaaattcaattactccctttttatttaccggctggaatttttccttagaagtaaatgaaatttcttttccattagagtttgcctctgaagattttacaacggtaattgttccatattcctttgggatttgtaaaaatctatcattaaatgaaaatttaattgttcctgaacgaccatcggcatcttcattttcatcctgagatcaatttacatcttcaagataattaaattttgctcttgtttcaaagaaaggtgctttgttattgatattaaatcttacaacttcggctgaatctacctttttaacctcttgaccccctgtacctaaaaaagaaggactagcttgattttgtatgtcaattgtatcaatttttagatcctgatttttatcacttaggggtttttgtaacccgtgagtgcttaggcttacttcaacatcttttattgtaaattttgtgattttataggcagtatttgcactaagatttaaagatgaattttgattggctagagtttcttttgaaattcgaacttttgaaattggaccttcagggacaaagacaaattttgtggtttggggttgttgttgttgttgttgttgttgttgttgttgttgttgttgttgttgttgttgggccaaatcaggatttgtccctttaacttcttggatttcaacctcgattttatgtttatttcgccaaagatattcatctttttcatcaaattggaaataaacagtagctgcttcatcttcataggctccgatttgtgaaaaattagtaagtcaagctttttttgccggggtagtaaattccgttttatccattctttcagttttataatcagaaatatcaattttttcacctttataaaaataagcttgaatttcatataaagaagctttatttaaattagtttcaaaactaattacatataaatgcgactgaccttgtttttcatctagcttttcgatttttgcagctgggaaattatttctaatttgtttagagttttattatataattgtactttaaagtgttttttgtcctgatcttgttcttttagatcttctgaagaaataaatcaagcataaattttggtctcaatccctgaagttttatctttttcctcagtagaaataatttgatcgtaaactctaattgggattccctcaattatttgtttttgacttattggtgtttgtggtattaagccttgaggatttttaaattcggcttgggtattaaacgatttattaaaatcgattaaattagatactgaagtagaccttctttttcttgatctttctgagacttctggttttcctattagttcaactttttcgattttatatttaaatccttcaaagattttattttggcctatctgtttttcttctgtttttgaacttgaagtttttggatcattaacttgattaataagggtatttgtttctttttcaattggatttgttcgagtatctagttgttttagactaagttgcttttgctgggattgtcctgtattatcatagatatcctcaagtttgacttgtattgttccatcagattggattttcccttcaactactgacattggagtattagaatttgttttatcttgtcttttataagaaactttgactttataaccttcaagatatgaagccgattgctcatctaattggatttttacataaacaacgctgttttccttatctaataaagttctttgaatatcaactactgaaaaacttgcaggggtagttcggaataatttatcttgaaaagttatactatcatcatcaaaattaattacttgttcagatttcccgttattttcatagacaacagagactaattgataataattaagcggttttagatcactggctgaaaaagtatattcaccacttgaagaatttggctgttgttgacccccttgatctttaagttcggctgttttttcttggccagatgttatatcaatgtattttaattttatttttcttttattttggcttactttttcaagtaatttcgttgtatttaatttgattttaatttcagcattattccctgaaagattaactttttcaatatttacaacataagcggcagtatcaaaagtttttattagtgtatttgtttgttgcttatcttgactaagggggtctaattttagactaacagccgcaaaattattacttgtatttgtgcttggtgctggactaggttgggttgcaaactcacttacttgataatttagagcactactaaaaagacttagatccctttttttacggctaggagcttgtggtgagtcttgagatgcacttagcgagcttgtagatcgattttgatcggttccaatatattttgcaagcgggaaatgttttattattgcctgatttgtattagtctgagggagaaattccattttggtaatttcatatctagtaccagaaggtactttatttttaatttgatctttttgaatatcaaaaattgcaagtccatcttcttttactactgcctcagcagtaagctgggcatcctcagatccattatccccttgttttttaaaactgattttaattttattatttactaaaaaccagtttttatttacatcaaaaaccattcggataaccgctccgtgtttgcgatattcggtctgtgatattgactctggaagtacttcttttgcagttgtatggaatttcttttggtcctgagttaaatttctaagaaatccaactggaacaccacttacaaaaatatcaacaattgaatacaaactatatttttctaaattttcaaaggaaaatttcgctgttgcttcctctccctgataagagatttgtgcctgagcttgaaaaattgccccggttctttgggatttaatcattaaatgaatttgacttgcctgtccttgttttgacttaccatttgaataggcttcaaaaaactttttcgggtctttaattttaatttcaatcccagcggatgtatcagataaattagtattactaatctcaattttttgaggaggattactttgggtatttttaattaaatccttattgattgtaattgaggaaattaaagattttgtaaagaaatcttttttcattggagtttctactttttgttgatcaaattcgactttaaggtttttaaattcgttttcgggagtgcttctttttgatcttgtagaccttgttataggtttttttgtaatttctaaatttttaactgtatatccagtggcctcgccaagattttcaatttgaaaacttgcttgattattttcaattgctacttttgaagtttttgtactattttgcccgccactattctgtttatttttaagttcatattcgagtgtggcttcaaaatcgttattaagtgatccatcttcaagggagtcaaaaaaagttgtaagtaaaacgcttgtcgggcttagatcagaatatttgatatcaacaactttaattgaactaagtttggttttaaactgcgtttttgaagtatcatttttaattgtttttgcaaaggggatttggtagatcccattagttcttacaactgatagtgaactaatttcatattcagtaaatttatcaagattatttttaaattcaaaagtagcacttgctgcaccggaattttcttgaacttttgcacttgctaaaactaccttaccggtttttttatttcttagggttagagttgtaacttggttattatttagttttaaaatttcattatttgaatttgaaaaggttattttaattgttgctgatctttgaagatcttgttgaccttggccttggccttgattatgcccgcccctggtttgactaggattaaattcgacattcgaaattactatatcagtggcaaatttaagtgttttttgttttgcttgatcgttaatttcgccgatttgtctttgttgacctttgattatcgcgcttgtaaattcattgacgatctcgaattttgggcctgtattttgatattccttatttgtaaaaattgcattcttattaattattttaagccctttgatcttaaaatcggttccttcttttagatgatcaaaattaaggctggcaacaagacgaccatcgccttgcctgatgatttttacttttttagtctgattggtttgcccttcttgcgcaatgactgtagaaacgctttgaaattgagccttaggttctttatcttcgattatttcaacttcgatttcttgattttcaagatagccatcgcggattggatcaaaatagatctcggctttaaccccatctgatttaatatcagaatagacaagatttttaacttcgattttatcaacatttacattaaatgattttttattttcaagttcgtgattaacccagatacttgaatcaacttgagaataatcattaattgatacaagaatatatttttgatttcgatcaagatttttaaaatcaaattcggcagaaattagtccgctttcgtttttagcagtccctgttgcagtaataattgcatttgttttttcatttttcattaacaaggttagctgttttgaattttgtatcaaaatttgttctgcgtctttaaaggaaagttttactttaacttgctcgcttttatttgattgaacctcaaatttaaaaagttcaggggctgaataaatttttgcctgactatcacttgatgtaattcctggggcataagattgagctttaatttcaaagcctactgaggtttgaatatttttatctttggttagattgctaatcttttcaatttcatattcacttccgggttgggtattctcaaaatttagttttaaaactaatttttcatcaacatttccggttgcctcaattgtttttgcatcttgattttgattttttggttttagcatcactttgatttgatcattttttaaatagatatctttgacgggatcaaaagttaattcaaggccgattttattatgttttttctcgaactggacaatttttactacacttgctgttgttgcaactgtataaaaattacgctcaggggctttttcatcttttaatttaggagcaaaatttattctttgggaatcaagaagtagttctgtaattgtataatgacttaatttttcaagattttttagatcaaattcggctgtatttgtattattagagaattttattgtagttttttcagaagcggcagccccatttgcattattttttaagaaaataattgcatttttatctgatttatttggtcttttgccaaaatttggatctttgatattaaaatcaattataatttttgcactatcttgttggggttgacttttaattgattgaatctgggggattgtataaaaataagggggttcgccttgagttttattagaatcttcttctaatttattattaagatattcataatttagctctgttagccctgaatcttggcctggggctgactcaagtccggcaaattcgtatttttttccaggataaagatttgatagactaactttaattgcattattaactacctgaatgtattcagggtttttattttctagttcttgactttgaacggttttagattcttcttgcttttcctttccttttttatcttctttttctcttttatctgtaacagcttttatattattgcctacttgatttggataggaaactattttattattttcgtctttaaatttgactttgaatttataattatttaaataactattaaaagttggatcaaaataaattgttgcaattgcgctagtttcacttatattatcaaaattagaaccaaaaatcttaatctttttataactagtactaaattttgcattttgttcaagaattcctgatgaactaaaaaattcagcaagttcaggaatctcaagatcgacaacttgatattcggtttttggatctaaattttcaagattaaaatggagaattaatttattatcactaaggatatattcttttttctctgggcctggagttccgcttgcttgatttgttggggcaagatcgactttgattgtgctagaaagattaccaaaaccgggttgaccaaaaacgagtttggcactaaattcatttttggccccggttttaccaactgaatttttaaaatccccttcaagacttacagcaacttttgcacttgtctctgttatttgatcaaatttaatttctgagacacgatatttgatgaaaaattcatcataaggtaatttttgtgcacttgattttcctaaatcaaattggattgctacggctagatctggtttttcggcaatctcaattttggctagtttataaacagaagatacttcaaaatcctcaagatcaaatttgatctcagaaccttcggctttagcaacctttgatttatataatttagcaggattatcttttttataataatataaataaagatttttatcatttaaataagcagactcagggaggaaaccaaaggtatattcaactttacttgccaaaatttttggctctaatttaataaaagttttaagatcggaaattgttgtaataaaatttctttttggtgagctgatctctaaatttttatttcaaagaaaaagaatatttttatagtcatatccatctttttgcaaactaaaaactgaatttggcacctttgaaattaataaaagtttatcaagggcatattttgtatcatttacaagacctttggctttaaaactgattttatagatcccattttcttgtccctgaaaaaatgtagcacttgttgggataattgagctatcatctaaatataaaagtgcttgtgccccttcaagattatcagctgaggcaattgttagatcgacattagcaaaagtagctccaattgcaatttttgaatcaattactgctgctggggtataaaaatttttaataaaagtattaccaaattcgatctgggcaccttcaagttcaaaactttcgatctggtaagtacgacctggatctaaattatttagatcaaaactagcaagatcggcagaataaattgcactaactacataagtctgacttgttttaagatctttatagtgcattttaattattttattttgtaattcctgggtggattcaaaactatcaaaattaatatttagccttttttgggaaaaagataaattttggtcaattaacgatttagttactaatttgaatttagcagttttggtttcaaataaacgttttttggtactatctttttcaaaatcgatttttggatcaagggcaattttctgcatcggtgaaaggggaatttcttgccgattatttgtatcaacataacgaattgcgctgatcttataatcaagtccggggtgtaaattatttagggcaaattcaacttttccgtctttaacaattccggcatcaacataagaagtatggatttcttgggcggttttagcattttcaagttggctttcaagatcatctgcttgattttttaggacataataatattcaagggcgacttttttcccttctagatttgctgcctcatcggcaaatttaactgatactgaagctgtagaaggagttctggcctcaaaattgattgttgatacagcaggaggagtatcaacaaaatttgtcacattttgtccaaagccaatcactttttttgccgaaaatcttttctgttttttatcatcaagataaacttttagatagtaacgacgcccaaaactgagattgctatatttagaatttattcttcaataacgactaaattcatcatatatggcagtataagtagctacaacctcttttccttctttatcttttgtaagatcaacatttaaatcctgataatttagtttaaaagaatcaagatcactaagggcaaactcaatctcgtaattgatattatcttgatttatatgtctaaaatcgacaatgttgtactgaagtgtatttcaggacttaagaaggaaagggagaaaaccaaaagaaccaacactaaggccaccaaaggctaaaagtgaaagaataatcgcacgtctttttgactttttcatcgctttttttgattttttgtcattgatatcatccatttttcacctcttttttcagtttaaaatttataaatttttgttatttatgaattttcctagattatattaaaaaaagaatagacgttaaacaaacgctattgtttcttcaaaaaaaatatagataggctaaataaaaaataactagatttattgatagttttaaatgatatacagtaattatactatattttttaaaacttaaaagaaatttttcaaaaaaaattttttaggaaaaattaacggtatttttacttaaataaggataatttttaattttttgaaataaagttgttttaaaattagaataatcttaaaaaataaaaataatttcattttttaagattattctaataattcctgtaattttgataaattattcttgttttttgcagatattaataagcaatttagttttaattttttacattgatttagtaatattgctcgggttgactgattagttttatcgattttattggctagaatatgaagtttgaaaccttgtttgatgatatattcaatcataatataatcaagattggtaaaaccaactcgggcatcaagaatcaaaaaaacagcggaaattggctgatctttttggaaatatcccgcaattattcggtcaatttggtctttttttgtctttgatacggctgcataaccataaccaggaaggtcaacaaataatttttcactttcatttttatagaaatttagcaactgtgtccgccctggttttgttgatgttttagcaatttttttattcgctaaagcgttaattagagttgattttccgacatttgagcgaccaataaaggcaaattgtggatcagaataacaattttctgggcatgatctaagaaattttcacactttttccccgtttttgacctttaaaaatcaagaaattaaccaaaaaaataatttacattttaccataaattaaataaaaaagctaatacttacttaaaaattttccaatttttttatgttttttattaatttaattgcttcctaactaaataaatttagattttttggtctgatttcctaataagttttgacttaatacgagattttttacttataaatattaatggggaaaattttctgcttttctaattgttgatttaactctaaaattactgcattaaattgacaactatttgctgaaatccgaaatcttgcatttttttgatagcgaatttttttatagacatcaagaaaactcacaccaattgcatcatttgctggtccggtcatcccgacatctgtgataaataaggttcccagtgctaattttcgggcatctgcagtttggacatgagtatgagtgcctaaaagtgcattaattttcccgttaaggtagattgccaaggtatttttttcactagtagtctcagcatgaaaatcaactatatgaaaatcagctttatcctgggcaagaacttgatcgattgcatcaaaaaaattatcggcaaactgatgattccaaggcttgactagtttattaaaagcaactccaagaagtgaggtaatccggaaggttttgccgtttttttcaattaccgttgagccatttccttgatattcgggggcaatatttaagggtctgactatatcggcgttgttaataattaggttgatttctggatttgatcagacatgattgccgactgtaaaaatatcaacccctaatttttttaaatataaatagtcttttttattaagaccttttctgccagtgatattttcagcctggacaattacaagatcaaattgatatttttgttttaagagttcaagttgttctttaaaaatttcaattccaggggcaccaaaaatatcaccaacgaataatacagtagcagatttcatcttgggctaaactttttacctttgcaaattaagtaaaaagatgccgatttttagcatcttttggtcaaaatggtatggtgccaacaacaggaattgaacctgcgaccccatccttaccatggatgtgctctaccgactgagctatgatggcaaaataatattaacattataacatttttttaattttttccaaataaaaaaatgctttttttaaagtagttaatcatttagaaaaagttttaattttaaatttttagataatccttaattttttcaaccatatcaagcttttctcagggaagatcgagctcatcacgaccaaaatgaccataaactgctaaatttcggtagattggtttcctcaaattaagccgagaaattaaactaactagacgaagattaaatacgtttttaataatttcaataatttttaccgttggaattttagcattttttaggtaagtaacattaattagttctggatattcattaccgattgcataagcaaattgtagctcgatttcggcagctactccggcggcgacaagattttttgctattcaccgggcaatataagcgccacttcggtcaacttttgtataatcttttccactaaaggcgccccctccatgttttgcagcatccccataagtatcaattatgagttttcgccccgtaagccctgtatcaccaattggtcctccaattgtaaaatcaccggatttgttaacttttttttcaaagtcaatatttaaattatatttttttgctgctggaatcataattttgttaattacaaattcaacaaaattatgatagttaaaattctgctgatgttggattgacataagcatacttttaacttttggtttactgttttgatcatagtgaatctcaacttgggatttcatatccgcacaggcaaattgaaattcacctattttccggagttcttcagcttttttaactaaaaagttagccaaattttgtgctaagggcataaaatttgggcactcgttagtggcaaaaccataaacaatcccttgatcgccagcaccgattgtaccgtttttctgatcgacaagggaagctatctcgccggattggcgatttacattggaaattattgtaaaatcattttcgttataaccaatttcaaataaaatctctcaagcaatttttacaagatcgacataaccacttgttgagatttctcccccaattataattaggcggtttgatgccattgtttcaacggcaactcgtgcgtgctcatcctgtttaagaatttcatcaagaatagcatcgctaatttgatcacaaattttatcaggatgaccttttccgactgattcagcaacagaaattttcgctgctaacatttacttcccttcaaattttcattatattataccattttttttaaaaaaatgaaaaaattttttagaaaaaatttttgcgcagggttttattaggaattttttgctttttgggctaaaaactcttcaaaactaagggatttatgtcgttttgttgtcaattttccgtttttaagcttgataattaaatcggctaaggcctccattgctggatcatgtgagaccataacgattgtggttttgtattttttgttgatatatttcaaggcgcgtaagacaatattggtattagtttcatcaagggcgccagtaggttcatcagcaaaaattactttggcattcttaacaagagcacggagaatcgagattctttgttgctgtcccccagacatctgcgatgggaatttgaacttgatatcatcaagttcaaattcggcaaaaagttgctcaatatcaagtacttttgacttatccttttgaagataggcgccaacttggacattatcataaccgttaatgtttcccaaaaggttataagactgaaaaataaaggagacattttggcgcctaaatttggtaagttctccgtttttaagataggcaagattgactgaatcaacgataatttccccttcagttgctcgatctagtcctgacattaagttaagaattgttgactttcccgatcctgattttccactaagaattgcaaaatcaccagcggcaatactaaaattaatatccgcaaaaactttggtaacaactgatccaaaaagataatattttgctacatttttaaagtcaataattgcgcctggcgagtttgtcttatcaatatttccgctcttaactcggggattatcattggctcaacggattaatttaagctgtttttttgttagatttgcttgatttgtatctttgataatcgccagggcttggttttgtttttctactttttttgttttggaaaatatattatacacgattttctcctttttgttgtaaaaaaattaaaaatttttttgtacaattttttctggtctaaaaaagaaaaaattggttttttttagctgttttttgaaaaaatttaatttttaggttttatccttgattatataaactgattttttgcttgtaagaaagtatcaaagaaaacttaaaacgaaaatgaaaacaactaaaatgattccaaaagcaaggaaaaaggtcgaaattgaaagtccaagcgataaaaatattgaatttgtaaggagaatataggaattaaaaatctccatcgcaataatgacaaacggaattgaaatcagcgatgaaatcagcagaatcggtaaataaatactataaaataggcgcactttcgttttattagcataacctaaaacatctaaaatcgcaatgttttgctgattttcgttaataattgaagaggcaataatcactaaaataattaaggaaacaacaagaaaaataataacaacaatattaattcccgctccaaataagttagcaaaattggaaataaagttagtttcaatattttttgcctcaagaccggtaagtccaatttggtagattgtctcgccataaatttcattaaaattttttagtgctttcttgatttccggaatattctgatttacaaaagaagggttagtaagcgaggcaaaatcaagggctgaagacgaatttagtcaaggtttttcttgattttttttatcaaaattaatcagatcaagaatttcttgctttgtatagccagcaatttggagcgcgcctttggttttatcagtttcattttcactaaaagcgaaaatgtttgcaaaaaaaccgatggtatcatctttgtttaactgatcaacactaattttggaactaccagcccaatatcctgaaggtgaatacaagctaaaagatttgctgatctgttcaatttccgggtttgaaagaattataccattaaatggcgataaattataattttttagaatattttcaaattgatcaagtcctaaaagtttgttagcgatggcctgtgaggttataagttcggagtttatatatgtatcggaaatgccaataattacaaatttagctttcttttgcggtagttttttgattttattataataacgatcaacgtgattaagaattgggacttcgattctagacccaattcctaaattatgtttttttgcaaaaacataattgattatcaaagggtaaatttcatcttttattgggtatttttcaatttctgctaataaattattattatatttatcttttatctcaattattgaatttttttcagtttttggattatagccataaattttgatactactttcggtattatttttagcgccataaaaactgtcaatataagtataaacttgattttttggcagattttcattagcgttttcactaaattcaatcccggcaaaactgatggtaaagtcttttgccacttgattatttaaataggaatcaactaaaaatttgcgataggcatcacggttattactttgaccaaaaattgagacttcataggcgcgatattcgtttttatcttgatcaaattgataataccaaaaacgaccttgatttggatcagaagaatcaactagatatttaaaatacggctgtttttgcttgattttttcaggaatattctgcactttttcaatctggtggacaactttatttgaaattgcaaaaatgttattccttaaagattcaggaagatttgctaaaacgatatcaaaaattgaggctttatttgcctgatttactttaatatttagacttgaacgcgaaatgacaaccggatttctactttctgaatcaaccaagccgtttttggaattaatcccaaaaacgcttggatttccgggacggaaataattaggggagttataattaacttcagtattttccccggcgggaacataaagatttttcccaagatcttttgcattataaacaacaagtgggcccccttcttttgttggcgaaaagaggttgattttataagcataatgccggttttgataggtttttttaatactattttggaaaatattataagaagataaagaaaaaatcaagacaaattggacaatgacgattgcaataattaatgaaattatttttcaaattgaattaattacaagtgaaattgaaaatttattaacaattttgctttttcagaatagttttgcgaccttttgggcaaattttgaggtattaatttcgttgatccctgaaagtaaatgataaggtttttgtcttaggttccaaaaaattaccaaataaattagtactgagataacaaaaaaaggaataattagcgaaaaaacaaaagaaatgggctcaaaattataaatattaatatcaaattctcagaactgtgaaattagattataaagtgggatttttccaaaaaatccggataaaaagcctaaactaccgcctaaaaacgcaattataaagccaattgaaagaaacgaagaggcaatttcaaaaagtgaatatccttgagcacgcagaattcctaggaccttattatttgttgaaatataccgtttgataataaaagcgattgcaaataggactaaaattgacaaaaagaggcttaaataaatattagtttttgaaaaagtttcaataatatttgttccaacttgaattcttagggctctttcggggtttaaatgatcgatttcgttagtaaaaaaagtgtgctgggaactattagaggcaaaatttttggcaataaaactgtcaatatcagcccgaaatttttccctgtttgtaccaggcttaagccggattaggaaataatttttaattggatttgattgataagaaaatcttgccttatcaaatccgaatttatttacataggctagcacctgattttgtccatcaagtttgacgtttttctcatcaattacaggatataaataatcaatactaaaatcagtgccaacaattatgtattttagaccgccagcatttaaaatgtattttggatcaagaagttcaattaatttttcaatatcactagctgaatcaggaattttgccttgatatacttcttttttatttttttcaaggtaagatttattaactttgactacataaccgcttgcattattaagattaattgaattatttgccaggcgggcaacaattattttcgaaaaaaattgatcatagaatttagctacattaatcccaaaaaattcgggattttctttgcctttttcgctaagaaaatccgaaattgagcgcagacgataataatcaagtgaaacctcattaacatttttattaaaccaaaacgggggaatataatttttatttggtctgcggttgactaataatttgataaattcagtacttttatttgaagaatcacttacaatttgactaatttttggcagacgattttggagaataaaggcaagattaaaattgttttgaccttcttcgctcttagcttcaggatttgttgtaaatcagagtggaatttgaacaagttgggcagcaaaaaattgactaagaccaagagattcaagatttagacctgaaagtaaaggattaatagaagcaaattcctgaacaagtaaagaaagaaaacgttttttaaaggctgaatctgaaaattttggattaagcaaaaaattttccattatatattttagggccttatcaaaacgggcctcaaaaggataattttgggaataatagctaataaatcctaaattttcgactaaatcggcaagattatcttcaagtcaggattttagtgaagtttttctattaaaatcatcgatataacttttagcaaaaactggatcggctaaaagttcttgaaattgggggtttttttctagataaagacttaaaagataaggttgaagaattgcccttgaaggtttagggagtcctaaaaatagaccttcttgatcttttagattaggtattttagctaataattcggtattatttagctcatttttgagtcattctgatttagttgcctgaaataatttatgaaaagccttggataaatccagattttcaagtttattttcggaaacaaaacgaattcaaaaacgcaaggtttttattactaattgagtaattatttccggattttggataatatttttctcaagtttgttaatttcggcttcagaggcaagaatataaattggttttaattttaaattaagggaattagggcccaaatcttcactaattttttcaggaattctaattgcatttaaaatataatagaaaatatcgccaattgagccagtatttgcaaaaatattatcactttcaagacttggaggtttaatattactaatttgattcccagttttttggtaattttctagacgaaatagtcgatagatttccttgatctggaaaagtttttgcctaatatcctctaaattctcaagattttggattgttaaatatttatttaggaatatacgttgctttaaatttaaatcactaatttttaaattcggattttgttctattttttcaaggatttcctctgagacaagatcaattcgagtatttctaatccctaaatcgggactagtggatgacgaatttcaatttgcagcaagaaattgaagatcgtagatatcaatttttctaggatcagattcaggaaaaaaataggaaaaaccaagttgactagcttcagaactcttaccttttcccgaagcatttaacattttaattaacgaatttattgttttctggcgggatgagtcgctgcgaaaaaaagtcgaaattagagcaattatataatcatttgggctaagacttgaccgttttgcgaataaattatttttttctttttgtttttcttgatcacttaattctaaaaatttgtcataaccataagaataaggtgtttttcttagaaaaatcaaattttctttaaaactttttaggtcaaaattggtaattaactcgtttaatccttcattaatatttgaataagctagttcattttcttgttttccgtttagtttttcaagaatttttatgacttgattttgatggtttttagcaaatttttcaataattggttttgctaaaaatccaaaaaaacctttggttttctcatcaactgctgcagagaaaatgcgagcaaaatcaatttcattaactatttcaatcaaagcggattttaacatttgctcatcaatggatccaagaagtgcatcaacaagatcactggaagtaaaaatatttaccaaatttttattattctgatttttattatcagaaaatcagttattaagatattggaaaaatttttcaaaatcaagggcataaataatttttttaacacccttaagtaaatttattggatctctaatcgcttttgcaagcgcctcaggggaggcatatttttgaatatcatcaaaaatgcgaattccaccaagaagaagggccggatttagggcataaatttgctttataaaaaaaagacttttttcataatttgtcttgccagaattttctgtttccttaattatctggtcaaaaaaattacctaaaatatcattaattagtgttggtctgtttgtttttagtaaaatattaccagctctagtaattagatcgattactaaattataatttttgattcgataggagagaatatcaacaagtctaatttcttcagcagccttggcaaaagcattaattactagatcaacatcgggttttaagaagaaatttttatcaactaaaaccgagttattaattgcatttgcaatctggataaataatgaactagcactattttgggtttcaatttcgttttggacgttagtagaaaaataataaaaaattaagggaattgttgcaatatttgaataattatcaacttgtttggttcagccatctttaccaatttttgcatcaatttcaaaattattattttcaagaaaattagcaagcaagctcaaaacgcgttgctgagaagaaaccgggtttatatttgtatcaactttaatcaaattttcgggtaataaacttcagtgatactgaccaaaatttttaaaaatataaccaaattgattattaggtaaggcaattatcccgtgcaaatcggcttttgggagaatattaaatcctaaatcgggcttattagttttaattttttttagtctaacaatttttatattacgataataatcataatttagtgatttattatgtttgaattcaacatcgccaaagtcaactttaagatcgacataattaggatcaattccgtagttatcaaaaacattagcaataatttttgcctgaaaaattggtggaatttttcctaattctgcactagaaacttttgcattctgagaaaataaacggcttttcttagcgttattttgatcactaatctcttgaaaaagtcgacctatctgctgctcttggatataatcctgattttgaaaattaattttattaaaaattcttggactaattccggaattaataaaatgaattacttgttttgcacttgcattctccgttttttgctggacatcaattgtaaaagtttgtcttgtaccgatgccatcaacgactttttcttcttttcccttaattttttgggaataattttgcagatgttggtaaaaatataaattagcatattcctgaacattttgtgctagacggagaaaagttgcattttttatattcgaatttgaaatattatttaattcttcatttgtaacaagtgctagattatttttattaagtttttgaatctcggcgattgaagttcttaataaacttgaatctccttgtttataaaaaggaatgctaagatcggtgattgaaagatcagaagagacaacattttcagagctaccatctattgttctaattcttttttctcagtagttaatattttctaattctttaaattttttgggataatttgcctttaaataaattaaatattccttaataaaaccagaaaaattttgaccttttgagtcaatttcttttaatttataacggtgatttatatactcaattttggtttttaaattacgaattcactctttttctaatttataaatttgacctggatcaagaattaaaaatgaactagattctcaaattagattatttactaaattaaactgatcagatctaatctgcatttggattccatcagatccctttttaaaattaataaaactatttgaattttgcaagtcggcaaattcaaattcaccattttctttttggtaaatatttaaaagtggtaataaatcctgggtttttagctcatagccgattccttgtttttttcaggaagcccctaaaattggatcaaaggttgcaacttttgttttcccattaattacaagcggattaatagagctaataataatttccttaccttggtgaaaaaatacaaggatatcgcttggtttataattttttgtatcgagactgattatttcattttttcgaatttggtatgtttctaattttttacggaaattttttttatcatttgtaatataaatcggaaaaaatgcttgttttgttaattcaaaactatcattttttcctaataattttccattaaggtaaaactctcgggaaaactccccagaggaaatatattcattttctttggttttatcacctaaaatttgagataaactgatataattactattaattattaattgttttttttcttgatttgtatttaaaggtaagtaaatttctggctcaagatagtcatatccattattttgggcattaccaaaatagttaaattcggtactaattgttgcatcctgaagacctgaggtttccttatattgatcaagtcggctaacataagcacggtttgtggtaaataaggcggtaaaaattgcggcagtaaaaaaaactaaagttattaggccgataaaaataactttggtttttaaaaacatcgcaaatatatgtttaaaaatctttttcataatatggcgccaaaccctaaatgctatataattataaaggaaaatttaaaaaaaccaaggaaattttgctgattctcaaactaaaaaagagaatttttttggctaattaactcttatttttttaattttgtggtataattacattacaaaattatccaaaaaaaaaatgtttttatattaattggagtagaaatgattgaagttttgtatataaaatcgcatctaaattatgaatcaacttgtaataaagtagcggatctttttattggtgaattaaaaaggttaaatcctagaataaaaattagtgaatttgaccttaataatgaaaaagtgggaaaaatttcgctaaattcagaaaatttttcccacttttgacaagatgttaatgctgatttttgaattgaaaaactaaaaaatgttcaaaaagtaatcatctcatcgccaataattaactggggatattcagctcagattaaaaatttttttgatgcaatctgtcttgcggatcgtactttttcttataaatatgcaaaaaaaggtggatcagttggcctacttaacaatcttgaaaatgtacaaattattttaagtgctcattcaaaacaagctgattttgtaagtccaagtccggctgagacaatttcaggaacctttaatttccttggtgcccaaaaaattaatccagctttaattatagaagaatcacataaatataaaaatgcaaattttgataaaaatttgcttgataatatcaaaaaagcagcggaaaatttctaaaaatggagaaaaaatgaatattcttgtgataaagtcatctgttaatgaaaaaaaaggttcttattcttcgcatttatccgatctttttattaaattttacctcgaaattcatcctgatgatcaaattgaagtctacgatttaaatcagtttgggctagcaaatacaaatcttactatgaaaaattttgaggataaaactttttatcaaaaagctgaatctgatttttgaattaacaagttaagaaatgctgataaaattgttttttcaacctcaatgacaaattttaattattcagcgaccactaaaaacttttttgatgcaattacggtgccaaacaaaacctttttacttgataaaaacaccggaaaatataccggattattaaaaaatattcaaaatgtacaaattctaacagcccaaggagccccgcttggttggtatccttttggaaatcatagcgccttaattaaacaaatttttgaatttcttggcgcaaatgttagatcagatttttttgttcttgatggtacaaaggtagctccaaataaccagaaaccaattgctgattttgtagcccaaagacaaaatcagataaaaattttagcagaaaatttttaaaatatttacaaaaatatagtataatttaataactttttacttacaaaggaagtataaaatgaaaaaaaatattcacccggttcaacgcgagctacttcttagttgctcaacatgcaattccgaatttagaattaaatcggttatcgaaaagtttacaattgatatctgttctggatgtcatccccaatttacgggtgatcgttcactcaatcggacaacagggagaatcgagagatttcgtcgtatggcagcaaaagcgcataaaaaaacaaaaaaataagaaaaaaacaactaagaatgataaaaacactagagcaattacagtcaagtttaactattttttatacaaatgttaaaaattttcattgaaatctccaggataaagactttttggtgcttcataaatttagtgataaattagcccaaaaaaccaataattttattgataatattgcagaaaagctccgatcatttggaaaaattgcgcttgctaattttgaagaaattatccagaattctgattttgaattatttaagtcccaaatttgatgttctaatgaagtactagataaattagcagagcagattaaaaaaattcttgaaatttgcgggaaaattcaagaagatcgcgatgaagataaaattggttatttaatttatccgctaattgatgaaataattctttactatcacaaagaattatgaaaaatttatgctcaaaaatcaaattcttaattttatttgggatcaagaggatatccgcattgatattttagtagcaaaattagctaatttatcacgaaaagttgctcaagatttaattttagagaaaaaagtcttaataaataacaatttggttctcaaaaagaaccaaattgttaaaactggccaaaaaatcaagatttttaacgactataaaaggccaaaacctcaacttgagccagcagaaatagattttgaaattatctttcaagatcaaaatatgattctaataaacaaacccaaaaatttggttgttcaccctggtgttgggaactgaaaaaacacactcgtcaatggtctaatttctcattttgacagtcttgaacaacttgatcatatccggccaggaattgtccatcggctcgataaggatacaacaggcttacttttagttgctaaaaacgcaaaagctcatagtttttttgtcaacgaactcgcaaatcgacaaatcaaacgcttttataaagcaattgttattggaaaagttttacacaaatttatgaaaattaatttgccgattggccgggatttaaaaaatcctcttaaaaaaactattagtttttttaactcaaaaccggcgattacaaatgtcgaactaattaaacattttagctaccaaaatcaagatttcagcctggttaaatgtcaacttgaaaccgggcgaacccatcaaattcgcctgcatcttgctcatattggttatccaatatatggcgatccaatatatggcaaaaaaattgacgaacttggacaaagacttcatgcttacaaactagtttttaaagatcttaatggtctaagccgcgaatttgaggcagacttaccagaagaatttaatatagcttttgaacagaaagaattataatcttaaaacataaaaaaaacttttttcaaagtttttttctttcctttagaatactaactgctataaattatcaaaacgaatctttattgaggggcccattgaagctgaaactgttagatttttgaaataatttcctttaaccgtatttggttttagccgtttaattagtcttaaaagtgtattagcattttcaactagttggggtacttccatattagttttaccaattagcgagtggataattccgtatcgatctgcgcggtagtttgcttttccttttttaatttcggctactgccttttcaggattagggcttacagttccagtttttgggtttggcattagtccttttggccctaatttctttccataacgccctaaaattggcattaatttgggttcaacaacaattacatcaaaattaaaattatcaattttaagattttgttctaattctgctgttgagtaaataagatcagcaccagcctctagtgattttgcagcaacttctgaagaatcagttgccactaaaacccgaacagattttcccgttccatgaggaagaaccacggctccacggagttgctgatcagcttttcgtgtatcaagatttagacgaattgctaaatcaacagagccagaaaattttgtataggaagtttttttgactaattccatcgcctcttcgaggctgtaaaaacgatttttatccaccatttgtcgtgcctggagtaaatttcttgaaacttttttcattttattttcctccttgcttttggataaattcttcaattccctcaacctcaacgcccatttgcattgctgtaccataaactgttaaaatcgctttatcgagattttcggtatttaaatcaggtaatttatattccgctatctctcttaattggtcaaaagtaatttttcctactttttcagtttttgattttttagaacctgattcaattttggctgcctgcttaattttataagatgttgggctagtaaataactgaaattcaaaacttttgtccttaaaaacagttatttttaccggaaccggttcatctccgcgatttttagtttcatcattaaattttcgggtaaactctggcataacaatcccaagacctgcaagggctgggccaggttttgcttgcccggcattaaattgcaatttagcaacccggacaacatttttctttgccattttagaacaaccttctttcttttaaaatttagattttcttagtaacatttaacttcttttcaccaaatcaaaacttaaaaatttaacactaaatttcttttttaaactttgatttggtgctctcgacaagacttgaacttgcacccgtctccggattagaacctcaatctaacgtgtataccaatttcaccacgagagcattaatggcggatcagacaggatttgaacttgcgcgggcccgttgagacccctaatacgtttccaacatatcctcttcagccacttgagtactgatcctaaagttagtattaataatattatatcataaaagataaaaaattaaaaataactatttcacttttaaaactcccaaccatttttttttttttttttttttttttcttttttttttttttttttttttatcttagcttttttaaagtattattaataaattgtgatataatttataaggttaaagtttctctgaaacttttggtttaaattttgagttttgattttaaattgtaaataaaataataaataaaataaagaaaataaagaaaataaattaaataaaataaggaaaaaatgcgtcgatcttttaagtgggccctatctttgactccaattgttgcaggttcagttggaactacggtttattttgtctcgggaaattcagtttcaaatttaggcgaaataaaaacaagcagggaaaatgtacaaattcaaagtcaatttaagccattttctccttcagagaccaatggtttaaatcaaattcctgaaaaaccgatacaaaaacaggaagaaaaacaagctcctaaaattcaaaaagcaccaataattataccagaaaaattaattaaaaaaacagaaaacccagaaaaacttaaaccaacaacaattataatttctaataaacaagaacaaattataccacaagtcgctccaaaaccaaataaaaaccaaaaaattttaattaaggataaagaatttgaaggagaaaaaccaaaagaagttgtaaataatcaaaaaagtaaacctttaaaaattcaagaaaaaaacaacctgacctttcacttctaaataaaaaaactccagaagtcattgatcctaaagtaaaaaaagaagaagatgttgctattgtgatccctgaaaaaaacaaaaaagaaaaaaatattacaaaaccaaaacctcccgagccaaaaattttaggtaataaattaataaaaaacaaagaaaatacaaaaatttcaactgcaaaaacagatatagtaataaaaaaacctgaacaaaaccaggaaaaatataaagaaaaagtaataaaaccaccgattttaccggttttatctgctcaacctttagtgcaaaaatctcccaaagttgaaaaaccactagaaacaccagtaaatgaaaaaaaaaattaagactgaactaacaaaggaacaaaaacaagaaaaaattataaaagttccactaaaacaacaacaaattaaggaagaatcagaagaaaaaactaacaatcaagaaatccaaacgcctattgatcaaaatcaaaaacaagtagatacaatcctaaaaggaattcaagaagatcttaagatcctggcaaacccaccaataaataacgaatcgagccaaacaaaagccagttataatgcagccaaaaatcgtatttataactataaatttacagataaaaaacaatttgatttatttaaaaaaagttttcccaaaacgccgttgacagaacagcaagctaagtatatttttgatttttgggaaaataattatgctcaatttaatccctcaatggcaagaatgcaatcggctagaaatatgtgaagagctgaaattaaaaaagttttaaacataattccaaagccacaagttggcgctttcaatcgggcaagtggaggacaaacttttataattgatttaagaaataaaaatgatagtggttgggttcaagcgcaaaaataacctaatttttattttttttaaactatttatgctcaaaaaaaataaaaagtacttaaaaggacacaaaatttcttaatttgagccctaatattgttcatatttttttaattttgtaaaacattttttatgtctataagacaatattactccaaaaatcgtaaaaaaatcttaaaaagaacctattaaaactgttatttttgcattttatagtataatttaattctgaatttaaaggataaaataatttttttcaaaaaaacatcgtaatttaaaggattttttatggattttaaccaaaatactgccttggccgagagagagagagagagagagagagagagagagagagagagcaaggtgaacgtgctcttaaatcagaattttataatacatattttctaagagttgataaaaatctttcaattgatcaaatacaaaataattataccgacggaattattaatggaaatattctcgaatttaagttaaatattactaacttaaactcgactttatttcaggtaatcaaatatttatcccgtttgcgaatcaaaggaattccggttccaaaaaacattttcctaatttccctaatggaaaataaggcatttttttatgattcaagtgactttttagaacagattgaaattgtttatatcggtgcttcaagtactaataatttggatttttatacaaaaatcgagcctgtagaactaaatttagcccaccctgaagaacaagaaaaactaattttttacttaaaacagcaaaattttgtcaaaattaacatcgatgaaaattgcattgtcggctgagcgaaaaagttttttagtgaaaatcccgggaaaaataagcaagatttcatcggcgataataccggtttgacccgagttttaggcgagatcagaaccccaaatctttttaaaaactacataaatccttatcaaaaagattcaaacattcgttttgaatatttaatggatcagctaaattccaagatccagcagaaaaatttaggcgctttttatactccaaaaccttatgttttaaaagcttatgagcttctaagaaaagcgattgccgaaattccagcaggaaatgattatattattttagaccgttgcgccggaactggcaatcttgaaaagtgactaactaatgaagaactttcacatacgatcatttcgacttatgaatattatgaatacaaagttttacttgaaaaattaggagataaagtaagacatataatcccaccagttgaggatcaaaatacttttttgcaaggactggtaagtggagcaaatgccctaagttttgagtatattaataataaaattattaaagaatatgttgataacccaaaatgttcaataattatctttgaaaatccaccttatgtcgagccgactgcaattgagcagcaaaagctaaaaactgccaaagaatccagggaatcctgaaaaaataactatgttgtacaagaagcaaaaaaaattagccatttaaaaggagcggaatttaacgaacttgccaactattttatctgatcagcttttgaatattatatcagaaaaaaaggcgatgctttaattgtcttttcgccagtaaaatattttaagtggcagaatgtagctaactataaaatcggtggcggttttgggtttaacagaaaacattttcatgcaagtccaggatttgtgagcctaatttggtggaaatatgaaaaggcagaatttaatgaagtagatcttgaagtttttgatattgatcaagaaaaaaatgaaatttccttcattaaaacagtaaaaattaaaaaaactaaaaaaatgtttagtcaaactatttataaatgaaaaagcgaaaatcccgaaagagtcgtccctgaaaaaggactttcttgcgaatataacggtcgttttagcacaaaaactggcaaaagtttgtacggcccgccacaaaatttggacaatgatcattttattgcttatctaaggggggatgcttttactctagggcctgccacagtcgctttagtaagagcaaaaacttataacgaacatggtttttgattgcataaaaataattttttagtcggccttatcgcctttagtgccggaatttttaaaataatggatggtagatgagaaaatacctatcttgttaaatcaggggatggttttaaccggtttttacaagatctaaaaagcaaaaaacactataaattagaacgttttttgctttcaaacctattttttgtcagcctgagtctaactaatcatatcagaagtctagcccatccagatttaaataattcaactatttatttaaatgaattatgccttgatgatcttaatcaaaaagaaactttagctctaaaaagtcttagaaattatgattttgacgatcaagaaaaggaacttttagagatctgaaaaataattcttaaacaagcggcacaaaccaaaaattacgaaaaacactttaaatacggactttatcagatcgatgaagaactaaatacaaaaactttaatccctaaccggaaatcgaataaatatatttatgactatcctgaattaaatgggaatattgaaactttaaaggttaaattgaaaaaatattattttgataaaattgtaccaattttatttgaatatgagtttttaaaataagttataatataaataaaaaagctaaaatattaaaaattttaataaaattaaggttacaaacacagtttttatcttataaaaactaaaaaaagttaaattcaacacgtactttttttagtttttaagttataagttaaacaaaaagtagcttgaagatacaaaaaaatctttaggtttcttttttaaactaaaaaaatattttagaattagttttgctttgctaaaatatattcaactaaagacctaaccataacaccagttggggtatttttgacaaaagcagtcgcggcaatatccaaatgaataaacggtttatcttcgacaaactcagctagaaacattgcggcagaagaagaaccggctttgccggaaaaatcagtattttttaaatccgccacttttgaatcacggatattttgggcaaaatcctgatgaagaggcattcttcaaattagttctccggcttcttttgatgcctcgttaaagttctttcaaattttttcctcatttgcaaaagctccagtaaaggtttcccctaaagcaatacgaattgctcctgtcagagttgcaatcgaaataatttcacttgctttttcttgtctaatcgcataagtgattgcatctgctaaaatgagccgaccctcggcgtcagtattattaatctcaactgttttaccattcattgatcttcatactgcatcgggcgtatttgcatcgccattaagacggttatcggtaagtggtaaaacagcgacaacatttgctaagggattaaattgtgataaggcatcaattgcagctgcacagattatcgctcctgacatatcaattttcatatcattcatatacatgccagttttgatattataaccacctgaatcaaaagtaattcctttaccaataaaagcagttttatattgtgatcctggaagcccttcataagaaatcactactaatttagcatcataagttgatcctctattgaccgctaaaagcaggttcattcctaattttcgcacttcattttcgcctaaaaccttgaccgttaattttggatttaggttcattttcttctgaatctcgcttgcaagaaattcagaacttgccatattagggggcatattttggtaataacgggcataattgacgctgttattaattatttggtatttatcaattatcggttttagttcatctaaataacttgaaaccactaaaatatcacgatttttagctcgatttttagcataatcggctcttagcgagaagatatcagatctttgaaaagcaataacttcgattaaatatctcaagaaagaatttggaaatttatcaaaattaatttgcatatcacggggataatgacctaattttgcagcaattttgcgaaaacggttcggagttaattcttttgagcgggagcctaaattaatataagcctttttttgcccaagatactcggtaatagctaaatcttcttttatcaacattggaatttgcgaatcagaataagctggttcaatggttattcgattggattcaaatttatttgaatacttgataaaaatttcagaaaaatttttcatactaactttgatagtcctagtaatacattttaatagcaatgcagtaaataaaattataacacaaaaaagttaaaaaattagaaatatttttttaaaatattttttctaataaaaaagttaaacctatatttaaaaatataggtttagataaaaatagcttcaagataatggattttataatttaaattaactcatttttcctcataagttgttttgatattgctgctatttactaaagaattatgcaaatcatttgtttgataagtgatttttcaaccattttcttttaaagattcaattgagaattcaaaaaattttaaattatcagtttttaattttaaaataccatcttttactaataaattagcataaatttccaaaaaatctttgtaagtcaagcggcgtttgtaatgacgattttttggtcatggatcaggaaaagtaagccaaattgtgcttgcctttccttttatccggtctaataaatctttagcatcacttatgaggataaaaaaattacttaaattatatttttttacatattttattgctttaactgcggcagaaggatacttttcaacgcctaaaaaatttttattgggattatcaaaggcaagttgacttatcattttacccttacccattccaatctctattattcaagaatcatcaatatttcagggtgtttttacaagtaaattctgattttgaattctttcaagcgcatcaggaatatttcttagacgcatattaaaaaattttatattttaaactatgcatgacaacttaaatcgtgttgaccacgcaattcaaaatgttcatcaacaattccgctttcgatttcttcgattgtaaatgttgtatggtgaatatgttttaaagtgtattcaaccgggatttcaacctcggtgatcgcctctaactgactaatttgaacctcttcggtattaaccatatctatttgacgggcaatttcgtaattctgctcaatttcaacaagaggttccggttcaactactggttcaaaataaactggttcaattagtggctcaggttctaatggttcaggttcaacctctaattctaatggttcaggttcgtgaaaaactggttctggttcaattgctaaaactggagcaggttcttcaactggttcctcaagttcctcaacttcctccattgcaggattttcttcaatttcagttcctcaatgcataatttttacgcccttaccatcccgcaaatcgccggtataaatcataattaaagtgataatatttcaaagtaatgaaagtccaagaatcgctccaccagtaattgttagaatataaacatcgtttctaatctcatcttgtgcagacgatcctaaatacatcatctgggaaataaaaatcattaaaagaccaacaattgtaaaagtaaatctaattattgcaagactaaatctacctaaataccagaagccaaaaccaaacaaaccaagcaaaagttcgttatagaatgcatcactttgtaaaaggccatcttttctttttttgtctaaacgtggcattttttctccttttttttgcgaatacagataaaattatggtttttgaaagaatttaaaaatcaattttaacctatcgatttgaaattatacaataaaaacaaaaaaatgatataaaaaaaatattttttttatctttttttattttaccttttttattcttttttctggaaatcgactaacgtataataataaggacttcctccttgattttcctcaaaaattgatttttcaacaagtgaaatattaacccctgaaattccgcttcgatagtttgaaataatccgggcatattcatcaagcgggaatttttcgactgttttgtttaggaattttggatatattcgaattcaaggacttagatttactcttgtattaattagtttattatttttatattcttcttgcatattaaatgtgaaaatgtaattttcctcatttaataagaaaattttataattttcaatgccgtttccttcagtatttttggattcatttgctaattttacaattactatatcgttaaatttattggactttggcagataaaaactatttttgagtgcttgatttttcagatctatgttaagatcctcattttgttgttgaaattgatcaatttctgctagtccacgaacaaaaatcgctgattgaagattggctaataaccagagtcaattattttcgaataaatcattaaatgatctttttgctttttcatataaaagcggattttcctgtctattaccaaaagctgtaccacttgaatttccaggtcagggatttattggattataaaaatttaatttaaaagctaaatcaaggatatttttttcagtttcaattttttttattcgactaattagttgtttttttgaatcctgacttggataaatttttgttaacagttctaaaatgatactattttcaaagaaaggttgggcaatatttttttctgtagaactaattatagcaaatttttggtattttttttttaaaaaatccgaaaaatttacttggtttgcgcagcttagcaaaaatagactactaaaaaatggtataaaaccaaaaaacagtgatttttttaactttttcattttattaactaaatttctcacttataatcatttgtgctggtaaattatagcgaaatttttcaacaaaatctttttcaaaatcattatagctttcttgagattgatggtataaagcttggtggaaaatttcggtaagaatttttattgaaattttgttttttgttttgggaaaataaaaaacaaaaggatttaaagtaacttttggaattttgcttgatatatccacctttaaattaattaatgtattttgctttagaatataaagatctttaaaggtggtaagaattaaggatgtatcgccttcagcaattgattcaagaaatttatttgcataaaaaaaaggctcaaaaagtggttcctgatttctaacatattccttaaattccggactatgaccaacttttttaccagttacttcattaaattgatcaggaaaagtgtatcatttatggaatgtaagactaattttatcaagtctttcgagaataaaaagtcaattttggcttacaaaatttttatattcggcaataattaagtcaaaatctttttcatttctgtttatactagccattttttggttaattaatttccagtctttttctaatttttcaatattttgcttactatgataattatttaggaaagaaattctttctttatcgttattttttcagattgcattaaaaatatattcataaactcggcgcgtactaaattcctctattttttcattattttttttaatctctagttttttatcaacaaaagaattatatttatcgagataagttgattttggagttgtatttttattgagtttcttttcttcttctagacttttttcaagatcaattgagtataaactgtatttataaaatttaaaaggactgttaaaatcagaaatatcagaggtaatgttagtaaaaaagtttgatttttcaaggtcttttttctcgttaagaatttcttgttctacttttgtctcaagattttcaagctgattttggtattcgatctcaagttctttaagtttttctttggctttttcgttctcaagccgtgtctggtcagcgtctttttctaatttttcagaattttttactaaatttaagcttatattgctatttatttgaccaaccttatgaaaagttggttttttttgcagggattgcaaaaattcaagctgctctttactacatttttccggattttcaaggctacaataaccagcttcatcttcctcttcatcttctagattttcatcagtattttcgggtttaatttcttgttgaattagcgatttttgctcctggaattcatcttcaagattttcccttgctgtttttaatttattctggaagtattttttctctttttcgttaatccaattttcaagactatttataaacaaaaatttatcaggaatttcctcatcaagatagaacatattataatctaatttagttttaagttctgattttgagccaaaaacagtgaatctaataaatttatttttatcaaaaattaaataataaacattatttatctcaaattgattctggccagaattaattttgataaaatcaaaatttttattagaaatttttattgttttatctttgattttttctacctcaagctcctgcggattttttaaaaaacgcgtttgataagggttaaaaataaatgataatttttcaatattttctaataaaaacagtcaattttttgctagatatgaatgaattgtataatttgcattttcccttgttgttaaatattcatcatttatcgaacgaaaataaggttttgaaaaaataagtgaatattttaattcttgacttatttttaggccatttttgttgatctgatttatgatatagtcttgtttttgcccttcattttgagcaaaaattgaatcaacaaattcctgaattctttgattttttaataaggatttattctcatttttgggaataaattcataaaatttataaatactactacaagaaataagaccaaaaaaaggagttactgttaataaaaaaaatgaaattttttttagcattattcactttcacgactattttgagaatatttttgatacattttatataaactatcagttttttgaccactataataaatcttacctttgtcgattagagtcaaactatcaattaatgtatcaatttcatataaattatgacttgacaaaaatattgttttaccttgtttttgaagaatttttataattgcacggaattcatttcgcgctgaaggatcaagattagaaaatggctcatcaaaaataattaattctggatcatgaatcaaagattggactatcataattttgcgtttttgaccagatgaaaaattaaatggttttaattttgctaaattttcaatttttaaaaatttaaaataatagtcaatttttttctttaccagttctggttccatttttgataaaaggccaaattcatataaaaactcataagaatttaactcacggggaaaaaaagaattttccggaacataaccgatgaatttttttgcctcaggtaacttatttagaaaattgttaattaaaatttttccggaaaatttttgataagcatcaacaatgcacttaattactgttgttttccccgcgccatttttgccaataaatgcatgaatttggtttttttttaaccttaaaactaacatttttaacccctgcttctgattttgaataaatttttgttagattttctacttccaaaatccaatcagacattatttatagtcctttcttgaataaataataaagataaaaaataataaaattgcagaaattagggcccagattactggataaattttttttgagacgacctgatagtggcttttgatttccatcatctgtaaaactggctgaaataaaaaattattgctttttgacaagttaaaacgtttaattactttattctcaagcactcgttgttcagaactaaatgaggaaaagccgccgatttggtagttttctttatcaattttgataaaaattggacccggatcgtaattattttgctcattttttaaaaaattatcaagtatttccgtgttttgtctattaaaataaagtcaataaattagcgcagttgcaagatagatttttttttggacttgattttcaacttttttaatatcaagtttttttgctaaaaccgcagtattttcatcatttagttccaaaagctctttattagctgaaattgtatccgaaattttttcaagaatttctttctgacttactttattgctaaaatttgcaaaaaatttatttgcaaatttatcaaaaattggtgaagataaaagttcttttattaaatttcactttaatttcccaacaagatcagaagtaagaccaaaagtctgggagtcctgaggtaaaattttggcaaaattagcagcattttcacttgcataaataatttcgcggttttctagattttcaaaatgggaatcatttttaagcgatcccgggactaaaaaaacttcctgtgatgtcgataatttatatttttttaattctggacttgtagataaaaggtaattatttttttttgatgccaaattattggaataaatataattttttaggaaactttcggggattccgactgcattttcaattgcatcccgatcatttggctcaaaaacattaattaactgataaggaatcaataaataagaagccgcctgtcaagcttgagctgcagctgagctatcatttcaagcctgttggatatattctacttgcctttttgaaaaatttgggttatctacttgttttggtataaggaaaaattggtcttttttttgattaaggtagaatttttcaacatctacaattgtatttgaatcataattttgatgttctaaattaagaatttctgcaaaacggttaatagttgatgttgcactaaaagctgaactagatccaattagaataaaaggagaaaatgaaaaaactgcaattgaaagcgataattttgaactaaatttattgccaaataaagctgtcattgccccaaaaatcataaaagaaaaaaaagaagataaaaaacctcataataaaggcgaatttacctgacctaaatatttaaaatttatcatataaaaggaaacaagtaaaaagctgataaaaactgaccataaaatcccaaaaaaagttaaaaacaaaagttttgtaagaataaaatattgccgcgaataaggttttataaaagttattatatcaacacttgaagttgataaatccttaaaaattgataaaaacatataagaggcaataattattgtcaaagagagatttataaataaaataataaatgagaacaaactaaaacttttctcagttgcatagaattttgcaattaaagcaagcatcattgtcattaagaaggaaagagtaatgaaaacataaattactttttttttaaaacttaacttgaatagaaatctaaaatattgattagatctaaaaatatttgtcctgacttgtaacaaagtcaacctcttctacttatctaatattgttgtataatattagataataatttgtaaaattttaaaatttttactaaattaaaaagcggaaaaccacttttaaaaaaataaaattaatatctaaaagtgaaattataacataaattatcaaaaagttactgttttttatttttaaggaaaaaatttatgataattggctttatcgggataacaaatacgagtataaatttaatttctaacctaattttgacaagaaatgaggtggaattcttaataatagataataattttttacgtctaaatcaaataattgaagaatttaatagtattatcgactatggaagacataagaataaaattaatttcacaaattatcaaaatttggaaaaagctgatattttaattattgaaccaaagcaaaatcaagcgccaggaatgaatttaactgatcaggcaatcgaaaatgctgaatgaatttataaaactggatttttagtacggaattcaaattttaacggaattacttttattttaggttattataattcgattttgtgtaaaatttttagttccacatctggacttgtagggaaaaaagtctttggaattggcactattttagaaaatatttattttaatatgcttttaaaaaaaacaaattctgatctagcaaaaactgctaatcttcttatccttggagatcaaggaaatagttttttaatcaatcaagattttaaaaataatgaaataacagataaaaataatgaaatatttgataaacttattcagaaaataaatgaaaaaagtttagaaaaaattattagaaaaacggcagaaaattgactgttagcatcaattttactagatattttactagatatttttcagcaaaaacaaagttttttcctaataaattcttgagttgaatcattttataatataaaaaatgattttttcacaattcctgtcaaaatcgatctatcaggtcaaattgaaactaaaaatattaacctaaataagcaggatcagcaaaaattaattcaatttatgtgaaaaaaagatgaactaaacacgcttattgacaaatatttattaaaataagataaaaattttattattttttgatataattttttttagtaaatagtttttgtgtttaaaactggaaggaaaagatggcaaaacttaattcttataaatttaaaggaatcggggcctcaagcggaattgcaatcgcaaaagtttttaaattagttgaacaaaaaattgaaattagtgatcaaaaagttgaggatattagcactgaaattcaaatttttgaagagggggtaaaaaaatctgttagccaaattgaaaaaattaaaaaattagcaactaagttagcaaaagatgagctcgaaattcttgatgctcatattttgattgcaacagatcctgttcttaaagaagatacaatcaatttaatcaagcaaggatattcagctgcttattctttaaaagaaacggcaaaaaatcatactaattttttacttgaaaccggggatgaatatttaatggctcgagcaactgatatcaaagatgcctcacaaagaattattaaaaatattttaaatttgaatattttagatttaagtgcaatcgataaggatgtaataattgttgctgatgatctaaagccctcagataccgcccaactaaattcatatgttaaaggttttgcaactaatattggctcaaaaacttcgcattcagcaattatggcgcgaagtttagaaattccagcaattttaggtgttagtgatattcttgaaaaagttgaaaatgatgatattttagcaattaatggcgatcttggttatggagttattaacccaaatcaagaagaaattgaagaatttgagcgccaaaaagccaattttgaagcagaaaaagaaaaattacaagaatttttaaataaaaaagcaactagtgctgatggaaaaaaggttgtaattgctgctaatattggatcagttgaagattcatatgcagcaaaaaaagtaaatgctgatgaaattgggctttttcgctcagaatttttatatatggacaggtcaaattggccttctgaagaagagcaatttttaagttataaagccgtaatcgagagtcaaaatccgaaaaaagttgttgttagaacccttgatatcggcggcgataaaactttaaaatactttgattttgcaaaggaattaaacccttttttaggctatcgggcaattcgtctttgtcttgataaattagaaatttttaaaactcagcttcgggcactagtaagggcttctgaatttggaaatttagcaattatgtttcccatggttgcaagtcttgatgaattttttcaggcaagagcggtttttgatgaggtatataatcaaattaaggctaaatatccaaatgttgctccaaaaagcaacattaaaatcggaattatgattgaaattccgatttctgcaattcttgctgataagtttgccgaacatgttgattttttctctattggcacaaatgatttaattcaatactcctttgccgctgatcgaatgaatgaaaaagtcgcttatttatatcaaactttaaaccccggtctgttaaaacttattaaaatgacgattgatgctgcccatgcaaaaggaaaatgagtgggaatgtgtggcgaaatggcaggggatatcaatgctgtaccgcttttattaggtcttggacttgatgaattttcagtttctgcaagtagtgttttaaaagttaagaaactaatttccgaactaaattatcaaaaaatgcaggaaatagcaaaaaaaacgcttgaattttcaactgaagagcaagtaataaaatatcttgagtctttaaatttaattcgccataactaaaaaagcacttaaatttaaagactttttttatattaaatacaaaaaaatatcaaaaaccgaaaaatttaaaaaaaaataatataatttttcggtttagctctagaatataattttttttaattcgtatttttttctttggaaaaaaataagtttttgatatacttttaaaagtttatgataaataagcaagatgtaataaattattttaattatcttattgaatggattaggcaagaagttaaaaaagcccagaaaaaaggtgttatttttggactatcgggaggtgttgattcagctttagttgctgttttagcaaataaagcttttccagattcacacttaggcttgataatgccgattcgcgatatgataactgatatggttgatattgatcttttagttaaaaaatttggtattaaaaataaagaaattaatctaaaaccagcctttgaaaatttgaaaaaatgctttaatttaaaaaataaattagcaaattcaaatatccaaccacgccttagaatgactagtttgtatgcatttgcccaagaatttgattatttagtgcttgggacagataatttttcggaaatgtatctaggatattttacaaaatatggcgatggcggggtcgatttattaccaatcgttaatttaactaaagttcaagtttgaaaaatggcagctgaaattgggattccagaatcaataattaagaaaaaaccaagtgcaaatctttgagaaaatcaaactgatgaaaacgaaatgggattcagctatggtgatttagatctttttatggaaaacccaaatcttgtaagtaaggaaattgctgcaaaaattacaaaattacatgaaataagtagtcataaaagggatcaaattcctcgtcctttaaaaaaattaggagaaatttaatggctggacattcaaaatgagcaaacataaaacaccgaaaaggtgctcaagatgccctaaaagcaaaaatttttaacaaattttccaaagaaattatggttgcagttgcaaaaggcggctcagatccaaattcaaatcctgcccttagactaattatttcaaaagcaagagcaaaatcaatgccaaaatcaaacattgaaaaggctatcgcaaaaggcgaaggatcaacaagtaatggtgaaaattttaaagaaataatttattctggaacgttatctcatggaatttcggtaattgttgtaattcttacagataatataaatcgggcaattgcatctttacaagcgctttttcggcgggcaaatggtcaaattggcaaacaaaactcaattccttatctatttgaacaaaaaggttatctcgaaattgaaaaaaataatctagacgaagacgatttaatgcttttttcccttgataatggtgctgaggatttccaaagtgatgagacaaattatatgatttattgtcagcctcgaaaaataagtgaactaaaaaatgaaatagaaaaaaaatttagccctaatttccgcgctgttgaaattagttatttcccgaatgaatgagttgaacttgatcaagaaaatactgaaaaaatattaaaccaaattgataattttcttgatgatgaggatatccaaaatgtttatcataatttaaaatttgcataatttaataattacgcaaatttttttaatatttatatattttctagtaaaacaagactgaactcaacagccttttttagtccttttttaattgaattatttaccatttctttatcagtgttgctctcaatctggtcagttaaatatttaacacagtaaaaatttagcttatttttacttgctgtttgggcaaaagcaaaagcttccatatcaaaaaaatgaacaaatttaaaatccttaacttgctttttcttaaagataaaactatttgatgaacctagattaaacttcttaccaattttattattttcataaaattctggttcactaggaagtttacccggcggatatcaaggtgttttggcatctaaaaggtagaatctttccggaaaaactaattgtttttccatttctggaaaattaattgataaatttgcgccacaagctccataattaataagattttcaattggaaattcttcaataattttttgggcaaaaattgctgcattaatcaggccaatacctgtattaatataaagaaaattgtattttttataccgatagacagcaatttttttttgaaaaatttcaatatttcttaacaaaattgcgccgaattcttctaagtttgctgcttcattagtatcggcataaaaaattgctgatttaattttggtgtctagcataaattttgttttgctctcgtgaatttggtaaatctttatggttgttataggcgatttcaactaatttttgaaatgctttttctagatcctgtcttgctaattttcgtaatttttgcactcctagaaaccgccgaccgcgggctaatttatcggcgacataaacaatcttatcaaataaggacatctcaaaacagaggctcgtatgacatgaaattgcataaataatttgctcaaaaggtaaacaataaacatttttaagtcaaattgaagccgaaagttgatgaagttgatattcttgtaaattcttaactgaaattttttgacttcttagaaattcgagatgttgatcttttgttcatttctttgtaagatcgtgaaataatccagcataataagctaatttagagtccaaattgttaatttttgcatactcatttgctagtttggccgtatttttggaatgaattaagcgcttggaataacctaaaaaacttgttaaaatttcttcggcataaagaaagtttttacctatataagctctaacttttgaatcaagaccggaaaattcaccttttctaatttgtgatgagctgaaatttggcaatttcgttggtaaaattaaaccgttataacgtttgagttggcgtaaatctggataatttttacgggtaaaaacaacaagttgaactttttcaagaatttctttataatttttccataatttaaaattacgaagattatcggaaccaataattaaaaagatctttgtattagggtattttttttcaaaaaaattaatggtatcgattgtataactaacttttttcgctttaatttcaaaatcacaaacatctgttttttcaatttgaaccaatttgagcatctcatagcggaattttggatcaataatattttttttttgcttcttaagcggatttatgtaattggggacaaaaaagagtttatcaagatttaaaaattctattgctttttgagcaatttctaaatgcgctttgtgaacagggttaaaagtccctccataaatagcaatctttttcaaagtcatcttttaataatcaattgctccgactgtgacagtggaacgtatttccttaattttttttgatttggcaatttctttttctggattttttaaaaatcggcggatgtaatcgcctacgccaccttctttattagttttgtttaataccacggttgcttgtttttttacctggggcggtgaatttttcatagctaccgaaatagttgaaaccgtaaacattccgatatcattgtaactatctcctattgaaataatgttattaagatcaattttataataacgagatagcattgaaactgcctttgatttattgaccccaattgctgtcatatcaaatacaaaagtatgattttcaccttttgatcaagcagaaaattcacctaaatcaccataacgtcgttctaaataaaatttaaagtcagcaacatttgttgttggttttgtatctagaattaaacacgtcggttttaaagggattttatgaaaattaagacctggttttaagttactaagatggttaaatccaaaaacttgctcaagttgtttatcgcgttttttaattttagcccatcctggaccttcgattgccacgttagaaatttcagctttaacccgtttatcgcccattatatacaaaatatcgtttaaatttatgtaatttatgattggaacaaagtcactatcagtcgggttgtgaacaaaagcgccgttaaaattagcgacaattgtgtttaacccgagcttttcataaacgggttttgttgatcttcaaggtcggcctgttaaaatacaaactatatgacctaattcaattgcacgcttaatttctgtttcagtatcaggatgaatttctgaatttgcactatctgataaaacggttccatcaagatccaaaacaaataaaaaacgggcttttaaggttttcattttcgaaaattatactataaatctgttaaaatataacaaaaaaatctaaaaataaagttatataattattattaacattatatagtaaaacttgataatttaaaagttttttttttttttttttttttttgcatctaagcggctacattttataataaattaataattttgtagtttttaattataaaaaagctgaaaatgttaattattaaacggttatttttaataaatttaatgaaaattaaaaattttcgatgagagaataacaagattttagcttcttttaaacaaaaattttcattctttttattattataacgctattataacaaaaattaaaaaatttccaaataaatttgaaaattttttaattaacattttcaagctagtttttaaagaattaaaagcaaaattatcaaaaaataaactaatagtcggaacaatttaatctatttttggtataatacaaaaattttaaaaaaggagaaaaataggaatttctggccttttttattattttttgaaatttattagcttttttattaatattaggtaagattgattagctttcttttttgaaaaggtcgtcaactgaacctataaaagcaaactcacttggggagacatctaaaaattcaccgttaatgatacggattactgaatcaattgtcttttcaagtgggacatatactccgggttccttggtaaacgcggctgccataaagaaattctgggtgaaaaagttttcgagctggagcgcttttcttacgataattttgctctcggcatcaagctcgtcaaaacctaaaattaagataacatcctctaaatccttatattttttcataattgatttagccgcaataattgcattaaaatgtctttcaccaattatattaacagagactgaatttgaagttgaaacaagtgggtcaaaagccgggaaaatattacgagacattttatcacgggagagcacaaatgatgaatcaaggtgagtaaaaagtgaaattgcagctggatcagagaggtcatccatcgggagaaaaacagtttgaaatgaagtaattgatccgttttcatttttaaaaagtctgtcctgaataaaagcaacatcggaagccattgttgcatggtaacctccgattgaaacatttttttcaagggcagaagaaacctcatttgttgcctgaataaaccgataaatattatcgataaataaaagcacatcttctttttcataatcacgggcatattcagccgctgttacccccattggcactatcatcgaacgagcgccaggagtttcgttcatctgggccacaaacattgttgattttgccattaaatttgactcttttagttctaaaaataactctagaccttcacgggaacgttctcctgaaccaacaaaaattgaagaaactttctgtctttgtttagaaacattaaaaataatttccttcattaaaacggttttaccaaccccggctccaccaaaaatcccgattttatacccttcaaaaatcggcacaaaaaaatcaagcgccttaattccggtctctaataatttatgtctaatgctaaaattttcttttccaacattaattatcgagttaatcggaattgttcttggtcgatattgtggtgtattttgggattgccctaaaatgttaaaaacttgattttttgctgaaggaccaaccggtacttgtaaaaaattaagagtatttattacttgtgagccaactgcaattggagccgctttggcaattacaaccgccctgacagtattatgattaagaatttttttaataattaaaaccgtgcggttttcatgcataactaatgcttgttcgagctgaattttttccaattcacttgtgaatttgatctcagcaacgtttgtccagatctgtgatatatagccaaccatttttatctacctccaattgtctgcgattttttaatgatattatcaagtaagctctcttccattttcggaaaactaaggggaatttccaactgagttagtgatccggtttttgctagaaactgatttgttagagttgcaaaatatgaaccagcaagttcattatcaacaaattcattatttgtatatttattaaaaacttgtttcgcaaatggatctgtttccacaagcacccttataaaatcaacaacttttgtaggatcttgaacatcttttaaaagtcctcaagaaattattttaatccccattaaaacacttgttaaagaataatgagaataccctttttgaatcaagaactgttcaacttgtgatcctttaaataaaagatcggaagtttccttgttaagatcatagtctaatttttctagttttgctagctttatttgtttttggtagttataataaagtgaggaaatttcttttgaaattagacgaatattttgagcttgaaccgatgatccagtccgagataccgaaagtccgatattaatagccgggatttttccctgagcaaaaagggcagaagaagtaataatttgcccatcggtaatcgaaattacatttgaagagacaagggcggtgatatcattatcaacggtctggagaattggcagggccgtaattgatttgcggccaataaattttcctgatcgttctaaaagtttagaatgagcaaagaaaatatcagctgggaaggcttctttcccaattggctgatttgttaaaagggcgacttcacgccagacactagcatgttttgttagatcatcaaaaacaattaaaacatcataattataactaagattttcagcatgagccattgcaaaataaggagctaaatactgatcaaaagggctagttgaaggggcatggagcacaattgtattcgccattgcttcattttggaccaaatcgtgatataaagaaactaagttttgccgtttttgaccgattgagacataaatacattttgtagttcgtgagtctttttggttaattattgtattaattccgatatgcgtttttccagtttgacgatcgccgacaattaattcacgttgtccaaaacctatcgggttaaaaagatcgattgcataaattccggtataaatttgccgatcaagtaattcacggcgtaaaacgccggcggcagtctcgaatgccgagtgccgatattgtaaaaaagttgttggtctagccgcgcgcggctcgattatatttcctgataaatcaatgattttgccaaaatattccattgaagtaaggactttatcaaaatttggaagttcgattagttcatcattgatctgaattttccctttttggttattaaaaagtaaataagcttgatcctgagaggcctgaattacgacagctttaatctctggtttatcttttacttgaaaaaattgttgttcctgccagttatactcacctttaacaagaactacataatctagaacggatgcaacttttaatgccattattgatctcctttatttttttgacttactaaattttgttttcttttataaataattcggcgtaaaaagacggttaaggtaattaaaattccggaaattgtcccaattattaagtataaaagattatcctcaagtcattttgaggtatttgctaacttatattcttgaattaaatctgcaaaattttgaactgcatttccgctgtcttgactttggcctgctgagttttggtctttattttcatctttttgagcaaaataggcgatctggcccaaaatttgacttaactgattgatttcccgacctaattttgtcattttcaaaaatgaattaaccaaatttgaggttaatttataagattcattatgaaaaagggcaattttttcgtgggcctgtgcaaaaaaacggttaatatcttcacgagttagattgagtttttccaaagtcgcatcaagttgtttggcggcttcagaacttgactcagctttaccatctaattccgaaattgtttgttttgccctattaaatttttcctgaagaacatataaattaataaaataaattaaataataatgaagtcaagctttattattatcgatctcggattttttaagataagataaaaactgaaactgggaagctgaaaaaacacttgatagcgaagaatttatatattctcgggccatttttttctgggcttctaaaaaatcttgattataaaacacttttgtaagtagatagaaaaaattataaattgttgtttgtgaaccaggggaataatagcgaatttggtcaaaactaaattgatcattgacattaacagtttcaaaaaaattatcaattacggctgtaacccctaaatttgaatggtataagtttgttgtaattgcctgtctttgccagggacttgcgccttcaaagtcatcatattggagactttcataaactttttcatattttttcttatccgatgattcgcggactttattaacaaagtcagtaattttaatccgcgctttaatcttcccgtctgtttcactaatagattcaatattatatttaaaacgggaatttaaagggtttaaaaagaaaaaaatctcggattttttttcttgggatgctgaattataaagatttataatctcgcttacggacaaatttgtatattcaggagcaacaattgggggtagatcaggagcaattcggacttcaaattccggtttttcggagatttgaggggggttttgtttggtaatttttttaattgctaaattaatttgttctatttctgattttgaagaagacggatttggcagttgatttaaagaaaaatccagtaaaagcgactgtttttcaaagtagtttttgatccagtcatttcaggtggataccccttctttgcccattggttttgaagctaataaaatattttctttatcatcaatactttcacggtcaagatttagattaaaattctttttatagaccggaaattcttcctctttgaataaatattgtttataacctgattctagtcctttaaaataagttttgatcctttcctcaaattcttgaccttttaaagtattaggaacatccaaaactttatcagtttttactccttgaatttttgcatagtcatcgttttggttatttccccattcaagcccttgataattttccttatcaaaagtgacatctccacgttttagttttaaattatttgcaaaagcaaaggggctaatgatattcaaaccatatttgcggggatcttttttgatcccctcacgatttttctggaaataataacgtagttgaatccaaaaaaaactttgttgtagtctttcttcgacattatccttatttttggcattaatatcggctagttttgctttaatatcattatcaacctgcccaataaaacggtcaataaattcctcttttttgctttcccatcaagcctgattttttttaagatcttcattagtgatcggtgttggatctttttttggatcagcatcagcttttttttgatctttttccccatttttttcttgatttgactggcctgcctggcctttatcattatcagtttgtggtttttcttgactaataatttccttttgggaataattaatcgctgaggttaagaaaaaaagcggggaaaaagttaaaaatggaaaaaatcgggaaaaaatcaacttattttttctatttttttgttttttatacataatttacctcagttctgaccagaaaaaataattctttaagtcgattttcttcattgacttgttttgttagttgataatttttgtataattccaaattttcaccaatttctaaatttgcttttagttgtaatttatgcaaaagtgtgtttttgtttttttgttgagcttttttttgaaagaaaaattcttttttatcaaccttataaaaaattagatcttcaaaaagatgaatcgaaactgtatcttcaagggaaaataaaagcgagtgatgagcaaaaaagtagtaaattccacttgaaatttccacttttatcaacgaaaattctaaatttgagacaataaaaggttgaattggggcaaaatatttttcttgttcaatattaagggaaattttgcaattttttaaagtaataattttattttcgggggttagaatccgaaaatttcaaagttttgcctccatttagaaaactcctttcggctttcttttaatgacattgagctcttcaatttctagttcccgctcgattttgagaattgatgttcgcagatgacgcattttctcttcaatctcttttaaaagcgtattttcatggattagcttatttttatagacaataaattgggactctaataataaaatttggactgaagttacaaaataactaagaatttgactttgataaaattcttcaaaatttggaaaaaatcttactctttctagatttttttcaattttttcaagtacttcctgatttgtttccattttgaattcaaaatggtttaaagggaaaattgttgcgataaaatcggtgattttatttgaataaactgccatttttacagttgaaaattgtcgatttttgattccataattgataatttcaccaattttcgttgaatttttaaaagtattatccaaattttgaaaactttcaagaatttgcatcttatttttgttagcaaaattaagtgcccgatcgcctaaagtaataataaaatctttttctttatagttttcaagaatttttgcctcaatttggtcaaaaaagttctgggtatatttctcatcagaagaaggataaattcagagactaacattttggcgaatcaatgcttttctagtaactaacgataatttagtgctaagcgatctttgataactaaaatttaccaaaaagtactgaccaattagaaaaaattcataaacattgcgaattgtgcgtaaaagaaggttaatttttatcaaagaaatattccgatttagtgaaactaaatcgtaaatttttgcaaagttagcccgtttttcctttatttcattaatattcataatttaaaactttcaaaattaggctttttttggcttattttgctgattttggatattttcaagacttgagactaaagaaacttcactaaaaatcacttttaatgttcgcgtctgtggatcaaagaaaataatacaaccctcgacaacctcgacaaaacggtttttattggcaataaaatcccaagctagaatgtttaaatttgcaagaactgaagaaaaacgttgatcgttactatcgctaaaaaaattacttgccatcacatttgaggattcttttagagttacaattggtacaagaccttttgagccaaaccgggatgaacgctgccaggaaatgacaaaatttttaaaaactaattcagttgtagccttataagctgctaaaactttttggtggtatttttcacggattactgaatttgctttctgagaagaaacaagtaaagttagattaaatagcgcatcaaaactaacaaaatttggatgattaattaaatcataataatcacggaactcggtttttgtatcaatagtatttgaatttgcttctttttttgcagaagatccaaaaaatttcataattaactcctattttttttaactttttgacttaagtgtttttaaattttccgactgggaatttttagtatttacttgtttttcaagcactttgtaatctaattgcgatttttttgtttttaaaattaaagtattttttccaattgatactaataaattaacaaaaacgaaaattccaactaaaacactaagaattccataaaaatagaaactatagtcaatataaaatgtcgatactaaaggacttttttcggcctcaagtgcaacaacggcatttgtataaatatgaatatttaataaataaatgaaagtaaaaagaatatataaactagtaaaaaagctaaaaatgagctttaatcataacggaaaatctttctttgttctaatcaataatgaataagtaataataaaaaacactatttgacttaaattgattcaaatagtggcaaaaactacataagataaataggaactaacaaaactggaaataaaagatatcaataggacaaaagcaaaaaaacttaacttgtaatccttaattttcttttctaattttgtaaaatttaaaaggaaataagtagctaataaaactagatgaatcgaaattccgataatcattggcaaataatttgttgttaaattctttccaaaaggtaagaattgaacaaaatttgtgcttgcaaaaatatttatataaatactataaaataaaagtgcaaaactagcaaaaattaacagtgaaaaacttggcactattttttttagtcggaaaaaactttgacggtaaaagtaaatttgcggactaaaataaagtaaggaaagcactagtaaaaataccaaaattgcaattaaaatgaaagaattactaatttttccaacttcggcaataaaagtatatagccaatctgcaaccgggttaccataacttacagtcgcgataatatcagcttcctcatttgagaaaaccattgatgcaaaaagtccaaataaaatcccaaaaataattaatgaggctgccaaactgacgtgacgaaaaataaaaaactttttataatcataatttattttatcatttttccgaccaattcagagccagagactataatcaaggaaaattaggacaaaaatttgtgttgaaaatacaagaatataagttcattctgttgtaagtcaagcaaaataaataacaatattaactaaaaaaagaccaaaaaatgccgataaaataagatatttttgcaatttttccttaaggcttaaaaatttaagtcctttaaagaaaaaggcaaaactaaaaaataagagcaaaactgatcttgtcattcgaacagcaagaaactcacgcatttcatcttcaattggattgaaaaatgttgaaatacttgagactggctgatcagtatttgaaatatttagaaatgatcgtggtccatcaaaaaaaatggctaaagccaaactagttaagaataaaacagtaagcaaaaaatacaaccactgcttttggccattttttgatgggtttatttctaacttgaagacttttttagatctaaccttcattatttctcctttcctagttttttcaaagatgaaatatattataactttttttttttttttttttttgccaaaaaaatgaaaattaaataaaggtaccttaaaaaaatcaaggagaatcactattttttttctaatttttttaaggtataataataataataataataataataataatactgattaaattaggcaaaaagttagttatataataaaaaaaagaaaaaaacgagaaattttaagtaaaaattcattttaaaactattaaaaaacagttttaagccagttttttataaatttttgctcatatttctttataattttttaaactatgcaaaaaaaaataatttttagcgacatcgatggcacactttattgtcatgattttaaaattagtcttgaaactattgattacataaaaaaaaacaaggataattttatccttgttcttaataccggaaatccactggcttcccgaatttttcaggttgcaaaaaatcttgaaattcgttatataatcagctcaaatggcgctttattcagcgaccttgaaagtggaaatcatactttaattaacggttcaatttcccttaaggagcaaaaatttctctttgaaattgccaaaaatttagatttacaactaaatttttgaaatactgaaaaatattttagttttaatgcaaaaacaaaatatttttcattttttatctacccacatcttcaaggggaaaaagaggtaatctttactgattcatatcaggaaaatgttgttaaattagagttaattggacctaaggcccaacttgatcaggcctatgacttacttgaaaaaaatcaggaattagaggctgttttcattaaaaatttaagtattgaaattactaaaaaaaatacaaacaagggaaaagctgttgaatttgtcagcaaaattttccaaagcgatcttgataatgtaatgacaatcggtgatagcggaaatgatctttcaatgcttaaaatcaccaaattttcctatgcaatggcaaatgcatcaaaaaaagtcaaagaaacagctcgatttcatacaagcgcatgtaatcaagacgggctaatttatgcgattaaagattttttataccggaaaaaatttgactaaaattatatttttcgaaaaaaatataaaaaaatttcaaaattaaactaaattcagttaattttgaaatttgtttcagttttacgctgttgaatcagttggaaaaagaaaactaaaatctgaattgttgcaatcgttaatccaataatttggaaaattagcgcagtcagtcagttattatcattatttaccaaaatttgtaagaattcataaattattcagaaaatattaagagttgctagattaactaagaaagttaggggaataaattttattgttttttgttttattcctaatatagtttgtggtaaaaaagcaaaatttacacaaaaaccggcaattatgccaagatatgaagccgcgctaataatctgacgttcaggaacaattttagctaaataaaaaataaaaagtaataaaattactagatagacaagaattcctgcgccaataaaagcaagattttctccttttttcttctccgttttaagcttatatgtatatacttggatcaagaaaactaaagttattagcccacaaaaaacttgggtaataaaaagtgggagatcatataaagctagtcctaacaaggtaaaaaagaaaattccaatataataaattcatcaactaagtaaggaagtttttggtggttgtttggcaatgaaagtattaattacaagtggaaggccaacaatggcggtgaaaaatgaggcaatatagccaattatatcaatatagtgcactttttttatcctatcaaatttataatttacaatttctgaaattaatttcagaaattgccttaattaataaaatttttgaaatttattaattaaattaatagaaccataactaaattagaagaaagacaacaattgtaataccaaaaaagattaaagttgagattgaatcagtaacagttgccaaaattggtgctgacatcacagccggatcacgtctaatcgattttgcaatcatcgggatgattgctccaagaatttttgaaaaaataattactactaataatgaaatcgaggaagctgccgaaattattagaatgtagtctctgattgttaaattcgaaattgaattatcagggatattaacatttttaatatcaccggttagggcaaaataaatcacaagtcttaaaaagtttagaatcattaaaattgtgccaataattaggccaacgctaatctctttaaagaaaacttttttaaaaaagttagtcttatcaacttcttttagcgaaattgccctgacaattgttgttgctgactgcgagccggcattacctgctgaaccagaaattaccggaatcattgaaacaattgtggtaataaatgaggcaagaccgattgatttaattgcattattttgacttattgcattagtaaattcttgaatgataaactgggacaaagttgatccaaacattaggatgattagtcaaaaaactcttgattttacgatctgtttaagtgtggaacgaatataggattcttcaacttcctgaggtgaaattcctgctagtttataaatatcacttgttgctttttccttgacaatatcgataatatcatcacttgtaaccattccgattagtctctggcttgtatttacaaccgggagtactgaaaaatcatttttggcaaaaacttcggctgcataatcttttttatcagttgtaacaagaaaagggacttgaaaaacaatttctttgatctgagtattaggatcagaaaagacaatatcttctaaagtagttgccccgattattttcttgttttgatcaacgacataataataatgcactaattcggagatatctttatagtttctaattttttcaagtgcttgatgacaagtcgaatctttaaaaagatagacgatatcaactgacataaaagcgccaatttgatcgtcggtatactgcaaaagttgatttatttgtttacgagtatcaatgtcaatgttgcgcaaaattcttttggcaacattatcagggacttcatcaagaagttcgacaatttcatcaacataaagttcatcaagtaatttattgattagctcatttggtaaacttagtactaatttggtctgaatttctggtgaaaagtaggtgaaaatatcacctgcagttgcagtatctaacatcctaaaaaataaaagtcggtcaaacggagaaaaacttgaaacttcttcggcgatctctgatagtggtttttgttttgtataattgcggacttcagtaatttttttggtagtaacaagctcaaaaagaaaagaactttttttatctaagctcattatttttaactattttttgtcttcaggtttgaccgcatttaactcttttgttaaaatttcaacaaatgaatcaagacttgtaaccttaaaaaaattagcatccctaacaattacaacttcaccactttgttctgagactacaatagtaatcgaatctgagacctctgaaattcccaatgcagcccgatgacgggcgccataacgatcctccagagttgattcagaaactgaaaaatacgttgatgcatacgaaattcgatcatcaacgataatcacagcaccatcatgaaggggagaatttttctgaaaaattgcaatcaaaagtgatgaattaatcattgaatcaattttgaccccatcagtggaaagattatccaaaagtgtgtttctctgaattgtgataatcgcgccgattttgttttttgaaagatgtttaactgcaaaaaaaagctcgtaaactatttttctttgtgttgaaattccaaggtcaagaaaactacgactgactttgtttttatgcaaagttttaatatgattaaagataaagaaaacaacaaaaacaagccctaatactaaaattagtgccactagtattaaaattggaacatctaaattcatcaggctcccttcctccccttatttacaatcacaggctaaaataatttacatttaaaattatatcttaatttaattatattagaaatatttcaatatttttccttaaattttcctttttttggagtcttaaataataaaaattctactaatctttgcaaaaaataaaattttttataaaaaacaaagattagtagaaaaaattttgtttttttttacaaaatttttaaaattggtactaaattatacctgccccatataaaacaaacataatcacaaccacaagaagcacagcaatcacagcaaataggacgaaccataaaacataggaaggcaagcctcaaattgttgatttttcggtagcaacaataataatttcttcatcttcatcaacacttgatgttgaagctgctattaccctagttgcctcatcgacactgagatcgccaagcccaacgcttagaccaccttgaagattatatccgccaaaaccacgtttggtattgaataattcctcatcgaccatcgcattatgttcatctcagttctgatcaagtaatgcttgataaacgatcccttgaaataatgggataattgctgggaatttattaagtgggtaatttcctagcgctaaaaactgcggataaattttaattcaggaataatcaagaacgatttcgacaatctgaggaatttcttcatggacaatttttttgccatgagctagaactaaaaggggacttatatggtgaaaattatcatcatggacttcataattaataatttttagaaggtagtcaattgaaagatttctcttggcaaaaaggtaacgacaagctggacaattttttgcttctagtaaaaaagctcggtatttaaggcagaatttacagaaataaacatgaacacaggagggacaattttcattataaggtagtttgtggccctgaccaaactgatatctaacaagcgcgcgggagtcaaaatatggataataagaaagttggtaaattttctcttcaatattaatatttctttgttttaatagttcctggcaagcaaggcattttctagcttctttataaaaagcgcgcaatttgctgcattttggacagaaaaaattatgattgcatgtcggacaaggagaattataagtttgctttcaaattaaagaatataaattctgataatcatttacacgtaattcacttaattttttctcaatatcaaaattttggagcctaaatctttcaagacaagttggacaatttttagcttctaataaataagttgcatatcgctgacatcataaacaatttgcattgtgattgcatgcctgacaagaaatttttgaacctaaattttcaaggtgttttgtatatgaaccataacggagctctaataatttggcatcaacattgaaatttttggctttaaatttctcaagacaagctggacaatttctggcttccaataaataagtgcggtatttctgacatcaagggcaagttgcattgtgattgcatgcataacaattgcttaaataagggttttttaataaaatataaggataagaaggatgggaaagctcaaaaattttcctgtttatatcaatatttttaaacttgaatatttctaaacatttaggacaatttctggcttctaataaataggtgcggtagcgctgacatcaagaacataaagcattatgactgcaagccttgcagatctgcgattctttttttactaaattttctttttttgatactaaattactagaacgaagctctaataatttagtatcaagatcaaagttttgctctttaaattttaaaatacaagctggacaattttttgcttctaataaataagtgcggtatttctgacatcaagggcaagttgtattatgagaacaagctgaacatgaagttttgaaagagctaaacgaagagactgagtcgcaaaattcagaatgctgataagcgatatcggcttctttttctccagcgacctcgagatccggactattaattataccatattccttatggtctaaaacttttttttcaacttttttttcaataccgacttcaaattctttttcttggccttttaaaatcaaaacttcggacgtagaactcacattttcaagtattttttcgtcaaattgatcggaaatttgttggttaaagattaaattatcatcttgattttcaagtttttcttctaattgaaaatcttgatcctgtttgattaaatttgggttttcagggttaaaactttcaaaaaaatcataagcatctgagggattttctagattttctaattctaaattttcatcagcttttttgccttgttggggaaaactagccgaatctaaaaggattttttcattttcactgactaattcaggtattttattttctagactatcttctaaaatttcgagctcaacaagatgacaaggacattgatgacttagggcttcagtttcattatctttttgacagatagcacattcaattttttgatcggcaccgttttgtttgatcgcataaagaatttcatcgatggttttctcatcctcggtaatgattaattcagttgcctgtttttgattctcgctattttttaaaggattttttaaatttttatcggatttttttgttttttcacttgtttgggaagctgaattatcaaaatcggaaaatgttttagctaaaaattcttcacgctgagcctgattaagcgatctaaagttaatcgctaaaggaaaagagattaccgatccaaatttattcccacgtaaaactcaaagtcgcactggagttttcaggctttcaatcttaagaaaaacatcagtaagtgagttaaaaataccaacggtttcttttgcaaatttaagacggtaatagcaatctttttccttgtgaaattcatcacaaatttccgttaaataaaatcttaaagttttcgttttgttcattttgtttagcgacttcttttaattataaacttaaaataatttaaattatagaataaaattgaaattatatgactaaaaaataaaattttacgttttgcttttcaaaaatctatttaaattgtaccataaaacagaaataaaaataaccttatttattcaaaaaattttataattttacatcttactaatttttttaacactttttttgttaatttcaagattttacttaaattttaaaggatttttttaattttgcgttaaaattgttaataatttttttcttgttttttcttagtttttcaacttaatagtttataatataaaaaaaataaaattttcaaaggataaaaaatgcagccaacctacaaaaataaaaagtttattgatgatattgattttttaaataaaactgtaattctccgtgttgattttaatgtgccgatcaaaaatggagaaattagttctataaaaagaatcattgcaagtcttaaaactattaaaaaaattgtaaataatggcggtaaattagtgattttatcccatcttggccggataaaatccaaagaagatctcccaaaaaaatcccttagaatagtagctgaaaaattagctgaaattttaggtcaggaaattaaatttatccctgaaaaccgcggtcctaaagtcgaaaatgcaattaaccaacttgaaaaaggtgagattttagtacttgaaaatacaagatttcaggacctaaataataaagctgagtccaaaaacgatgctgaattaggcagatattgagcctcccttggtgatgtttttatcaatgatgccttcggaactcttcatcgggctcatggatcaaatgtcggaattgcaacttatattaaagaatcagcaattggttatttagtaaaagaagaattagatgccctttcaaaactaattttttccccgcaaagaccattttatgcaattatcggcggggcaaaaatatccgataaaatcgggataatttcaactttattagaaaaagctgataaagttttaatcggtggcggaatggcttatactttcaaaaaagcacttggttataaaattggtctttcgatttatgaagatgacaaacttgaacttgctgctagtctagtcaaaaaatatccagataaattaattttagcccttgatgcggctctagccccagaatttgccgatcttgaacctttatataatcaggaaaatccccttgaaatccctgatcatttagaaggaatggatattggccctttaacaattgagttattcaaagatcatctaaaagatggaaaaactatcctttgaaatggaactttaggcgtagccgaatttaaaaattttgcccgtggaaccaaggaagttgccaaaattattgccaatctaaaagattgttatagtatcattggcgggggagattcaatcgctgcaattgaagccgaaggtcttagtaattcattttcccatatttctacaggcggaggtgcttcaattagttttattgaaaacggtgatttaattggtcttggcccaatccaggaaaaagactaaaagagctttaaatttaaaggtttttttaaatcacgcagatttaataactaatatttttcctaatttttctaaaaaatattagttaatgaaatttttttcattttatatcatttataatataaaaaatgaaaaaaattatgaattagtttaagattttgaaactaacttaattttatgaaaaccgttttttttgatgtaaagattgttaagttattaacaaagacagtgaaaataattctaaaattagcacaggaaaatccacagtttttctaccaggctttcttaaaatcacttgcatatcaaaccaagggctgaatttctttaaaaattaatcaacaattcatctttgatgttgtttttttcattatttgaaatttaatttctgatatatatcagaaaaattatcaaggattaaaactcataaattaaaaaaatttagaaatttttatatttttttaaaattttttttaatttccttactttttttaaaaaaataggcgattatttatttatatcgataaataatctagagaaaggaaaatcttatggaaatttttaaaagaaattttgttttcctaaaacaaaatttaaattcaaaatccgaagtttttgaatttattgccagcaaggcttacaaactgaaaatcgctgaaaacaaagaagaaattatcaaagatctggaattccgcgaatcacagatctcaaccggtcttgaagcaggatttgcaatcccgcatgctcaaagtcaggcagttttgaccccgagtttattttttatctcccttgaaaatggaattgaatgggaaaattttgataaaactaaggcaaaatatcttttctgcattttgttaccaaaaaaaggttttgcaactagacaagttgaactgcttgcaaaaattgctagcataattcttgatcctgaaattagtaaagttctaacatcggatgatccagattttgtctttaaaaatctggaaaaacattttcttgaaaaattagtagataaaaatagagaaaatcaagaaaatgttaaaaatctaaaaaaagttatcggaattacttcttgcacagttgggattgctcatacttatcttgcagccgaaaaattggaaaatgccttgaaaaatagtggctattttcccaaaattgaaacgcgcggctcggctggtccaaaaaatattttaactaaaaatgatataaaaacagcagaatttgttataatttcttccgatctcgagattgatacaactgcttttattggcaaaaaagtttatttttgcacaacaaaagatgcaatccataaatcagaaaaaattattgaactagctcaaaaagccccaattttaaaggaaaattttcaaaaaacagtcaatgaagaagccaaaacaagtcaaggtaatttcctaagacatataatggctggaatctcttatatgattccttatatcatttttggtggaattatgattgctttatcccttggaattggtaagtcaatttatgggaataactctatagctcccaaaggtgattttctctggtgaatgttccaaattggtctgatctcctttcgattaatgatcggcgctttaggtgcttatattgcctattcaatttgtggacgggccgggcttgcccctggatttattgtctcaactgtggctaattcaaatgatcttttctatggaattggtggaatcgaggtcaaaacgccaatgggatttattggtgcagttttatttggttttttagtcggttatagtgtaaaatatcttaatagtctaaaaatacaaaaatcacttgcgggtattatgccgatttttgtaattccgatcggcgtaagtcttttttggtcactaatggcaatctttataattggggcgccgatcggctgaattttagacaaatttattgaagcactcaagtcgatttttcttaaaaaagatagtcttggcctcggaatcgcctttctcttagggcttttacttgggtcaatgattggttttgatatgggaggtcctattaacaaagttgcttatttaagcgctaccgcgcttgttgctagtcaaatttatgagcctatgggaatggtggcagccgctattcccgttgccccttttggaatgggtcttgcaactcttatctgaaagaaaaagttttcccaaaaggaaaaatccctgggaatttcagcatttgtaatggggtttatcggggtttccgaaggagccattccctttgcgattgtcgatccaaaacgggtaattagtgctaatgtaatcggatcagcaattgctggcggtcttagtggtattcttgcagtaactaattccgccggacacggcgggccaattgttgctattttaggggcaattggatcagacaagcacggacttggtctgggaatcgcctttttcttgattgcaataattattggttcgctaaccacggcactaatttatggttttagtaaaaatcgtagtataaaaattttcactttttgaaaaaaattatgaaaccgaaacaaataattatgaaaattaataataataataataataaaacagtttttttagtagtacttgtagttgcacttgttttgattattgccggaattataatgctcatctttggaattccgcaatataaggaatttattagtcaagtacttaaacaaaatgctaaaccaagtcatagcccaatttttatttatggtgtttttttactggttttagctattctacttttaattttagatatttttattgcaaatgatatctgaaataagaaattacaagtaaaggagattaattaaccatgaagatggtgaagatgggggggttaatttatcaattaacaaatccacagattaaagataaaatttgagccggtgaccgacttgataaacaaataagaaaacgcggaaaaatcggcgaactctgactaatttcagcaatcagaggttctgaatcactagtagatggcagctatccgctttcgcttttttatcaagaagttccggaatttttttgcaattatccaaaaaaaacctacccaaatctccataaaattattgatgcgggtcaacctttaagtctacaagttcacccagatgatcaatatgccaaaaaaaaatataactcacttggtaaaaatgaagcctgatttgttataacaagagggagaaaaccattcctgattggagcaaaatcacttgattttatcgaacatatgaacaaaatcactaatgaaaatattaatgattatgttaattcttatgcgcttcaaaaaggcgatcttgcttttatccctgccggaactatccattcgattccagaaaaaagtcttgtctatgaaattcaacaaacaagcgatatcacttttcgaatctatgactttgaccgagttgataaatatggcaaaaagcgaaaacttcatcttcaagaagctaaaaaagcaataaaaccggagctaaaacctgtaattgtcaagaaagacaggggagttgcgcgtcaattattacttaaaaatgagcatttccatctaactcgaattgaagttgatcttgaatatattcttcttcctaaagaagatgtctattgatatgaggttgttattcttgaaggtattggtataatggcaggaactaaattcaaaaaatttgatgcctttattatcagtgggcatcttaaaaagccgattttgtttatcgcgatgaatgcaattattttaatcaacgaagttagataagaagtttaattataccataaaaaaagttttcttaaaaaatgcaagaaaacttttttttttttttttaaaaaaaaaaaaaaaaaaaaaaatttactattattatttgggtaataaaaaagacccgtaataaaattacgggccctaatcctgagtttcccagtttgatggcgaaaattcactttttagtgaatatgaatatgcagaaatcgccgtaaatcggtgttttttacccgtaaaaccttaatttttattaattacaattaattacaattttaaagtaattttatggtataattataaattatgaaaaagcataatttgattttgtttaatgtttgaggatcttcaaaagataaaatatataaatatgttggctgaacacaaggttatgggaaagctccaaaacgttgatttagtataggaaatgtgcaaactttggaaaaaattaatccaaatgctattcaaattatcaaagaaaaattgaaattattttcaaatttagatgacaaagataaaatcaagacaactttacttgattctcttaaaaattctgccataatcgaaggttcggtttttattggtggggaattaattgaaaaacttattgaaaagcacaatatttttgaatcacttcctaaaagtagacataaaaatatgagacaaatttttaactacttaatttcaaagcgaattactgatcctggtagcattattaatgcttttgataaaaaggatgattactcaaatcaaataaatacttccaaaaatagcttttatagactcttagatcttgtctatgaatcacaaaatcaacttttagatagtcttaacaaaatggttataagcgagcttggaaaaagggacaatgaattttattttgattcatcaacagtctattttgagacatttgaaagaaatggattaagaattcctggctattctaaagatgctaaattcaaagaagatcaaattgtcattgctttagcatgcgataaaaatggcattccttttcatattaaagtttttaaaggaaatacagccgattctagtaccctaatcccttttgtattagatattgaatctaaatataatatcaaaaatatgacaataattgctgaccgtggcatgtccactgctgcaaatattcgatttcttgaatcaaaagaatataatttcattatttcttatcgtgcaaagataggcagtcaaaaatttaaaaattatttattagatcctagcgattatgttgatctaaatccagattttaagtataaaaaagaagaattttattcatcttataaaaataaaagatacactgaaaatattagaagaagaattattacttacagtaaaaaaagagcaataaaagacagcaaggctcgcgaagaacaaatccaaagttttattaaaaaacaaaataaagatggttttattgaagtaaacaaattgtttggtaaaaaacctaaatattttagggaaatttcaaacatgaaatttgaattagatcaaagtaaaattgacaaggacaaacaatttgatggttactatgtctatgaaacaaatatactaaatttaaatgtcttagacatagttgaagaataccaaaaacagtgaaatattgaagctaattttagaagtctaaaaggtttattgaatattcgtcctgtatttttaagaatagatgagcatatcctagctcatacatttttgtgctttatctcattagttattttaaaaactataatttttaaaatcaacaaacatattagtgataacaagttattcgcaaacagtcaattaactgaagttggtttagtaacgatgttgcaaaaattaagacaaagggttgaatttaacactttagatcaacaaatgatatttaaaaatcgcgatggtgttcctagcgatcccaatatttgaaataggtatgatttctactttgatatcttaataaatcagtaaaaaaataggtaattaacttttggcaaaaaacttaaaaaagcacggaaaaccggacacttttttaaaattatctcatcaaactgggaaactcggaaaaaaaaaaaaaaaaaaatttactattattatttgggtaataaaaaagacccgtaataaaattacgggccctaattttcactaatatgtaaaaaaaattacaaaatatttaacatatgaatttgaattatttggctaatttactttctttgcataaaccctaaaataaatagaaaagtaaattataaaccataataatactaaaataaaatatttagaataaaaagaaaggaggataaaaaatttaaaatttagatttaaagagaggttattctactatttttttagagatattaaactctttgaaaacattattaaaggcgttatttgtaaatgcgattgttttaacctgtcaaggagctacattaagattggcgacatcgttagaatctcctgttccgcgatagaagtcatagataaccgaagaattaatcactggaagtcataaagtattaggaccttggatctgcattaccccaacaaaacgtatattaccggaattaaacatttcttcagggataacaactttaaatttaatccatttttgcttgtctttatcttcgcttgatttttctgggcgatcttgctcctggactcttagcgcggctatttggttatcatcattttggaaaacaagccttcaatcttgtgttttgaaattcggcccattttggaaacctaatggtccgtattttcataaaggtaaaggagcatttgttgtaaggacaaatgtccttgttttttgatcaaagctggatttaagcgcttggagagcaaatccttctctgatcttctcccaggtaggggtctgcccctgggaattcatattgctgttttcattttctcaattaccaaaaaacactgttggcttataaaatttctcctttgagccgctaatatttggccatcattgagtaatatttggagcaattagttttgtattatcttcaagttcctttacatctttaataaagacatcagcaatgttagcagttataacatttggctgattggtaatgatatctttatcataccagaacgtgagatatgcagacccccagtcagcatagttattattaacttgcttctggattacttgttttaattttgctccagatccccgatctgagccttcaggttcaacaaataaattagtaataaaatcacttgaattatataaagtaacctttcaaggttgatttaaaactaggttaagataattttcaggtagtttttgatttggatttggatattctttttgatcaggatgaatatttgttcatcccttagcaattttaggggattttttctcatattcatttaaatagtttttaaataaatcatatgattttaacagtttttcttccccttttttatttgaagcatccttaatttttgctagttcatttccaggatcaaaaattctaattgaaagacctagtttaccatgatattcagtgtttttaagacctaaagcctgaataaaatcttgcttaaatcgcttttgaccgtttgaggaagttccgcccttgagttgttctgaaccaatataaccatcaaggccggttgatcagggaacaccaattgatcgttcaaccaaatattttggtttgatcattattattttatcagaatagttagaaagattagtattattatctcgtttaagagctatgagtgcgggggtaaaagtttcgggcttaatatttttattaagtctttggattagacccgagccttgattacccccgcctggttgttgttgttgttgttgttgttgttgagaactcacatttcctttattatttaaatatttatctatatttcttcagtcctcattaaaatagaaaaagggattataatcagcaaaagtaattggtgtattcattaatcttttgatattattagctcttagagaaaattctaattgatgatcacctgcttcatttttgattacttttaaatcttcaattttataatttggatcattatttactaaatttgataaggtaagacggtgagcttttgttaaaggattaagaatattaaactcgtcttttggattataggtttccagttcttcttcttttctaacagctttcttttgttgttgttgttgttgttgttgttgttgttcagtttttagaccaagctctcttattgttttaactaccgggctaagacgcaacatttgctggtgaatcaccaaaggaatacttgctagtcatttatcagaaatatttccgctggcatcaactggtatttgatctttgaattttaagacaaactttgtcttagccgcaagcggggttcttggatcatattgctcaacccatttagtatcgaatacttcgggagcagcactcatttctggtgctttttcaattgtagtattaacaattaatgacattgtctcatctgataaaactcgaatagtttttccgttgtcttcaagagtttttgctaatttaaattcaacgcggaaactaagctctgaaactttctcaacattgataatctcgaattcaatttctttatcattttgttgataatattggataaattgattccctaataaaattgccagtttttgttttaaaagacctgcttcttgattatctaggctcttatttccttgttttgaatcatcttgtccttcttggtctaaatcagcttcttcttggaaattagtactaaaataaggggactcgattattgaaccaaaagttgagacatttacattttggctttgcccgttttgatttaatttaccttcaaatcaatctttttcgggacttgaactaatttggggaattactggttttttaagtttatcatgaattaaagtatagccatcattatttagttttttaggtagtggtttttctttttgtttatgttgaactgctaaggaagttgctaatttttggaaaaccccaaatctttcagtatcaagataaaaactttgaagacctaaaggtgcattttcaactgcttgattaagttgatcaattgtatctgcttctaatttggatttccctgaggttttaagataaattgttctacttgaagaacgaattacttcttgattaaacttgccagcattatcatcaaaaccgattgcataatggaattttaattgataaacatcagctcctactttttcttttacttttggatctagctcagctatttcttcaaaaataatagttgactttgcccctgaatcttgataataatttcagttattagaaagagcagctgaggtataaaaagcagttaaaagctcttgtaaattggaaatttgtctaaatttagcatctaaattattttttggtttaactttaagtttatcacctagataagtccaataaagattatcgcgagttttgttaattcaagattcttgaagatcttttaaaagtttatactgaagcctgttattttgatcaaattcgttttcatcaccaatgattttttcccagattttagtactaaactgggctaactgatcctgattagatagattttgatctttaaattggctaataatttcttgttctcaagggctattagagttttgagaactaccaatatttgaactattttttcttaattcttttggtaaaaataaaggaagaccaaattctggggctttaatttcaccatcataataattattaaaatcaagtaaagataatttgaaattatctttttgactaaataaaggtgttttaatcctaatattcttaagatcttcaagattgaaatcagaaggaagattttcatatccttcaaattgaagacccgctttttgtcctaattttactaattcgtggattgtttgttttggatcaagacctaataaataacggtaatatccaaaaagtgatcatttattttggaaagcaggagaagcacttgaataaatctgccagtatttatttttttcggttttatctagaacaaattttgcattttctatatctctagagcttggaattcttggatttacttcaaaaagttgttcttttaatcttaaagaaatattataagtatgtctattggataaaagtttggctaatttggtataatctttggccttaattagttcttgaatttgtgattttgctagataataacgttgattttggacatcctttatcatataaggtttatccggacttgaacctaaaccggccttttcttgctgatattgaatcggggaattctcaggaagtctttcagtaatattatcatcttcttcaagaccatcttgattatttattgcttttaaattctcatctttttgctggctaaattctttaagaccctttttcgctttttctttttccaaacttgctctttgctctcttcgggcttgttcaagttcttcattaacacctggatataaaagtccaaaagctttttcgatttcaacatcacggaagttatctaatttaaaagttacttctttttcgaataaagttttaatattaggttcttgatcacctaaaattgaagatttaagactaattttgattggtaattcaatgaataatttttttgtaattgaactttgtttaatttttgcttttgaaactaaaaaagtataatcaagatgactggctaaatcatcaaaaagaaaattatattttcctaatgaaaaccgaagattacgagctaaagttgcattaactaaatctttaattgaattaggtttagaaactaattcctgaagttgggaataaaaacttagagcatcatattcatataaactaaatttctcaattcttggtttttgctgatcttttttaaatttaacccgatcttttaaagatctctcactagcagggacaggtttaacttgggaattactagtaattgtctctgattggcctccaaaataatcagagacatctaaaagatcaacatctaattgatcttttagatcattttcattagcaaataaactagttccattacttgcttttaaatcgatactacttaagaaagtctcatctttgtatttatagtcttttaaaatggttttagcctgaggactaaattcggttcgaagataaagtctgacggttttttgatcttgattaagatcactagctcattcttttccattttgcggatttctaataaaagaataaacaaaaggatcaactaaattgcctttttcaaaactaaaatcggctgtctgcaaacgaatatttgcttttagagcttcaagatcaaagaatttttcaagataaactcaaagttcgtcctgatttttaaactgattaagttttgctataaaatcacttgaacgggtcagtgcaagcggctttattgattgagcagaaaaattagataaaggatggataattaaattattaaaatttttatcaacgatataagaatattgacccagggccgctttgggcatatcaagtggtaaaagataaataaatttagttgctgattgagctatatttccatcttcaagtttttcttttagatgaaatccaagacgaaaacgttctttatcatcctcggggctaaattccgagataaccacctgatattttttcgggatctccaaaacggttctcccattattagtcaaaaagtcaaattttgagacaaaatcagtaaattctgaactttttggatcaaaggttttccaatttaaaagtgcttttttaacactttgataatcgcttgtaaaatttgcaatcgaaggtttaaatgcaacagaatcaatcagtcctaattgagatattactccttgagttggatttacaccccgatatttaacttttgaagccaagccaacaactgtcccaaaaacagttgaaccaataattgccgccgctgtggctaatagtaatgttgattttttgtttttcataaaaaacctccgggtttttctaaaatttttcctttttgtctctttgtataaattataatataaatttaaaaatttttatctaatttttactaaattttttttaaactaaattttccttaaaattttctaagaataattcttaaaatattgatccataaaggctttgcgcacatttagtcttgctttatcatttaagagtttatcgcctttaaataccgcaaaccctttaaaggtcatacccactcggtcttggggattagaagcttgtggggttgtatcaccgatctgtccatagtcaaatcctctacctaaaacagaagctagctcggtttctcagtttgtatcctggttttggtatttatttttatctttgatcttaatttcggattttcaaacttttagtttgctatcttctctttcttgttgttcaggaattatcgtaattgttgcactttcatcatcaattcttatttccattaatcaagtttgaccaagataatgttcaagtggttcgatctgatttggtttagtttgtctaatatctaaattgaaggtctcagcttctttattttggctattttctttagtttgaggcgatgaagatgcacctggttttgaatcttctaaaagaataatctcagttgatttatgtctaggaagatcggctacttgtggaggtaagatcttatcatcattaactggttttgccccgattagttttcagactaatttaaggttttcttggtatttggtttttactagttcaagattagagagtccatataaagatttaaaatgaacattggttgttgataaaagtttatagtttcttcctggagctgtctttgatccttttattcctaaaatttgttcaggtttaaatgctaaatataaaactcctttagtaagtgcagtttttcttagagcttctttggatgcttggaaagtataaggatcatttttttgatagtcatacacaagtgaagatttaagtcttagaccctgacttgattcttctgataaaggtagattatcaaaaagtttatgtacccgataggaagatttagtattattaattgaattaattgccgaaacaaattgccttccttgaagatatggcttgtcccctgtatcttgtttatattcaagaccggaagttccatcaaggaaaatatcaggagcataacgaagtgatttttcaagggcaatattagttgctgatataccatgtaattggaaaagggatgcagctacttgaatattttccttatcaagtacccggaatataacattatatgttctttggggcgtattatatcatctactaagtgataatttctgatctgggccaactttaaaagtttcaaaaatatcaagatatttaacaagataatcaccaaaggctaatttttcaggttcaatttctttttctgtttgttcattggtttgatctttttgatcatcttgaaaagttgttattttatgagtttggtatgaagctgaagatgatgctgcttgttggctttgaccttgtccagaatttgcctgatttgtctgggaattttgagcagtattttgtgtccctgaagactcattagtatttgaaggactagtttctgagctagtttgtttatctttttcttggttttgagtttgagtttcagttttttgctcagggctttgagaatgtttttgttggtcttgttcttttttatcttcttgtttttcttgttgtttttggttttgtttatcttcttgtttttcctgtggtttttggttttgtttatcttcttgtttttcctgtggtttttcgtcctgctctggttttttctcttcttctagtgggggaagaacttcttcttttggcgggagttttacaatggttatttcactaattggattaagtttttcttgaagatatttttttgaggcctgtttttcttcttgacttagctcaaaatatttatcaagtttagcttgagcaaaaatcttgtcaatgtctgttgaataaatttggtattgattatttttattaattccaactctgtggaaattaccaactaatttttcaagttcttgttgaattggattacctttaatatcaatatcaattggataagttcaaccctttaattcataagctgaataacgaatttctgaactaaatattgaatttgcagctgcagctccaactttaagatctaaagatttcccttgctcgactagttttttaccttgtttgtcaaattcaacatagtcgcctatctctccggcgtcgatatattgtttattttttgaatctacttctaatttaagattagctaaaggactaatttttaaattaaggcggattttatttgcatcaattacatcacctgcttgaatctgacctgtttttttagcaagatcaaactctaatttataattttcataagatgatcttttatttctaagatcaaaccaaaaattaatattatcaggaagaattactttttggttttgatcttttaaaagtgttctataatttcaaccatgaatttttagaatttcttttagctctgtttttgcttgatcctctaaattaattggtttttcctcaggttttgcttctggttttgcctgggattttgtctttgggtttgtctccgggtttgcttgctcttgggtcgcctttgtctccgaactagattcattagaagaattacttgcctctgaggtcttcgcagtactatgtgaggattcagtttgaggacttgccatttgttgggccccattagaagattgattatttgttgaagtagaaccttgctcggtattagaatttgttgttggtgctggtgtttttggtggtgtctctggtgaagcttgaattgttgctacattgtttttgccagaatcagaacttttacttttctgagggctttggcttgtctggcttggtttataaagttcctctaagaatttttctacttcattttgcccacgaagttgatcaaatttttcccttgaaaaacttcaaattacttcctgaattttttttcgcggattttttcttagatattcattaatctgaggtcttatagttaaataagcattctggtttctaaatatctggctaaatactttatctttgatctcgccaattgaagcaagcccgtttattggcaggattagatttttttccttcctatttttatctaataatttaagatgaattgatgctgttcctgcctggtcatctatatcaagttttattaatgatttatcagaagaaactggtaataaagtatattcatttggtaataagccttgaagtccggaagccgctagtaatttaaggccaccaaaatcttttagtgtctcaagtaatgcttgatttaatttttcattttcaaatactaattttttcacaggctcaataactggggctgcaacttttggtgcctcagctggtttttcttgagctggcttttcttgagctgacttttcttgagctggtttttctgcttctttaggcttctcttgcttttgatcttgtttttgttctgagccttgagtgctttgctgatcttttcctttttccttttcggacttagattccttttctgagctttgacttgtttgcgcggtttgatctgttgaacctgaggaacttccaccactggatcccccagatcctccagatccgccctcttgttgttgttgttgttgaaactcagtaattgaattagttagtgctctaacttggatagtttttgtttcttgaaaactttctggggaagtttttcttagatgagttagtaaaacatcttggaatttaatagaaaaagctgaaggtagaactatttcggtagcaaaatttttctttaattgatctttatcaagttcgtaagttgaagattcagcaacgaaattttcgataaaatcctcttttgcaacacttgaaaacccactaagacttgtatgaaaagctcgagtagctacttctttttttgtaattgcatcaaaaacaaaaacagttaaatttctaattgaattaccttcaactttagtattatcattaacctgaacattaaaaaatagatgcgcgaatttcttatcgattttggaaaaatcgattgcatctgttaatttaaaggcatataaaggatttttatggagttcaaaagcttgaccagctgatattttacttcagttttcttttaagctaaaattactgattatcttggataattcagtatcatttattggtgacaataattcagttgcagatttatcatttttaaattgattaagataagaggatctaagcgctgaattttgaacagccagacccactcccgcggttatcccaataaaactaagacctgctagaacgattattgctttgttgcgaatttgtttcttcataatgttaaaattataccaaaaagatttaaaatttttttatttttattttaattattttttcgaatttggaattctatttaaattataaattattttttaaaatttatattcaaaaagtttttaattttttcgttttttagtaagtcgttacctaaattttttagctattgaactaaaaaatttatccaaaaaaactaatccaaattagttgtttttttaaccaaaaatatgaaaaacaatctatttttccttattttttcctttttttttaaattttttaaacttttttcttaatattttttgaatccgccagcaatccgaaaaagtgaataagagtttataagcaacaaaactgataacacaattacaaaaaccagataagaaaaaaaatatgaactaactagcgtaatagcggttgtaataattgaaaaaatgctagaaaaaataattcttgctgctagttgaattccattttggaaatggaatttctcttttgtaaataaattataacttaaactataaaaagaaggcaaaaataatgaaaataaaacttgaacaaatataataattataatataactataaaattggaaatgcatattggcgcttttagggattataagtcaaataagatggactaaaattaaaggaaaaattagaaaattaatattaaaaatcttaccttttttatttgaaagtcaaaaatttataagagttccaataacagcggcaaaagaaaaagcgatattcaaataaggtcctcaaatttgaaaatcataataaattaaatttttttgatctaaatttattcctgaattaatgtatttaaaaaattgcgcaaatcctgataatttcggaatcataattattgaaattacaagtgatcctgaaaaaataaacaaccacttataaaaattgatttttgggtaattatgaattacttttttaggtttttcatctaacatactaaattcgattttttgggaatttagttttaaagaataatataaaaatcctgaaactaaataagtaaataaattaaaaattatcattcagtaaaattctaactttgtatataaaaaaagtccaaaaatagccgaaagcaaaaatcccatactagttgcaaaagtagacaaaatattaatatttaccatttgtttctgattttgggctaaaaaatagacaatattttttagataaataaaacgaaaagagtgaataaaacctaataaagtgttaaaaaaaatcaaaattattgaaaactgataagttttaatatctaaaccaaagaaaaaaataataagtaaaattccaaggacaagcgcactaaaaagatcagaaattagaagaattaacttatcattttctcagcgttttacaatttttgtactaaataaataaactattaaacttggtagttgaattaaaagatacaaaattgttactagtcaaaaatctccagtaattttataaatataaagcgaggatgaaaatttaaaagcttccgagccaaccaaggaaaaatttaatgaacttgtatatttacaggcgtttttaatgaaatttgtcattaatttccttgcaaattcataataaatagaaaaaattttttaataaaatttttgaattattgctatgaatttttgaagccggaattgatagggtaattgaattttgattctgaaaattggtaatatcagtagaacctgatccaaaaaagggtctaaattcaagcccgttttcatcaaaaagattttttactttttcataaatatcggaattataagccataaaaggatcggcaactcttatttttaccccctcaacatcccaattttcatcttcgctaacatctaaattaatcaaaaatttgtaattttcaacttcttgaattagctccttgtcctttgtgccctgaagttgaatttcttcttttgttgttaaaacgatatttgcatctgagataaaatcaacaagtgtttttagtactaaattggaaattttattatcgtgatttcgggcccaaattacaaattttgccaccttcaatttattttttggcagaatttggtaaatttctttgtgattaattttatcacaaagtaaatttgggcggttaatttttcgttgtttttcatcagaaaaaattaaattatccattttttggcagaaaatttgcccggttttttcaccatttttatcaaaaacctcaaaaattccactttctcaataagggcttccctgattaaaaacttctccgtttataacaattccgccaacttcgtcagtatgtgcaataaataaggtattttttttggggttattaagtgaaaaagttccaccttttgtggatttagtgatttttcctataagaatttttttgataaaaggttcttcaaaacccgtcaaggagggaaaatttagaaaatctgtcagtgatttgtttatttttgcaatgtttttttggattttatcaaaaaacattgcaagatcataaatactttttgtatttttgatatagtcaaaaaatccgtagataaaatcttttagatctggcaaaacattggttaaatacttatctaattttttaacatcaaagtgaatttcgagcattcgatcatagttataatataaataaataaaaaaagaatttcagctacttaccaaaaattcttttttatggagggaatattctaataaatttttatttctaaatttatttcaaaacatcaccaaatcggctattattgaagtcattttttgatggctattatgaggatagacatcatctaggacataagtcatcattagaatttttttaaaaaatgccgattctaccgatgtttttcaaatattctcccactctgttttttctaaaaattcttctggaattgtttctagtaaaataaattcaacatttatgttgttaatttttagaatttttaaattttcatcaactcgaatgggaacagcaaatttttctgctagtaaaaaagtgataaatttttgccttcaaattaaaggcccattcaaaaaaccaaagtctaaatcatttggaacgcgctcgattaactttttagaccagtgaatataacttcctttgaggaaaattcttaaatttagaccttcttttttgttaaattcctgcaaatatgcagcaattattttgatcgtttctgtcattttaggggagaatttccttgtcagtttctctcgggattagttgaacttcgcgtatatcattttttccaattaaaaatagcatcaatctttccattcctaaaccaaatccagaagtaatcatcggagttttttctttcatttctaaatatcatttataattttgtgggttatttttgtggtttaaaagggattttaatgtttcattataatcaaaacacctttcaccacttccaactatttctccgattcccattaataaatctgaattaatcgcaaaaccatctttacttttttgataaaaaggtacattaatttctggaaaattatctaaccataaaattttatcagaaaaataattaattaaaaatttttcaccttttgaatttatatttaaaagtagttcggttcgatcgatgccttctttaaatttttcatctaatatttttatagcatttgtaaataataaattatattgatcaaagtttagtcacttcaaaagtcttggtacattattttcattaaaataatttagttcagcggaatgtgttttaactaaatttttaactaaatattttagataatttataatcattttttttgtttcaactaatggtttttttgtttcaatctcaaaatgattaaattgatgtaaatgtctttcatcaacattttcgccacgaaatgttggggcaatatatccgactgattcaacattttttgttcttaaaaataattccaaatgaaattgcatgctgtctgctaaataaaactcaaaattcggattatttttcgaaataactttataaggtagtgaatcacttccgagccccataggacttgaaatactttgtgttgttattggacaatttactatttttacattgttatcgcgcattcacttgtatgttaaaaaattaatttctgaataaattgttaatattttggcataactttcacttgatatgtgctttataaaatcatgcttaaaattcttaaaattcacagttattgagtttccttttttatatttttttgcgtagtaaggaaattctaacaaaatttttagttttttaaaacaaaagcaaaatttttaaaatttttttcataaattagtatcaaacttaattattaaaaaataatttttaattaaaaaaaattaagatttaagattttaaattaaaatattaccaaaaaaaatgttctaaacttagttagagctgtaattttttaaaaatttttttcaaaatcacagctcacaaaccactttagctttgtaattgtcaggattttagttgtttttttgtcccatagacaaaatgatcctcagaaatcgcgaattcctcgatcacatttggatatttttgttcctctaaatattgattattaaataaaattggggtaaaaggaatatgagcatttgaaatttttggtactgaatttaacaaattaattgtataaggatggactgggtttgcaaaaattgccgaagtttttcctttttcgacaatttttccagcatgcattattaaaacttcatcggcaatatattcaacaactgataaatcatgggcgataaaaattagagaaagatttttttcttttactaatttttttagcaaattaataatttgggcctgaattgaaatatcaagtgaagccactggttcatcggcaattataacttttggttcaacaattaaggctcgagcaattgcgattctctgtctttgaccaccggaaaattcatggggataacgataggcatatgatcttaaaagattgacgctttcaagtgcttcataaatcaattcgcttaaaacaaatttgcgaattgattttttaagaaagaaaaatggtttggttttcattccatagaaaagttggatatttttataaatccgatttaaattctgctgctcaaaaccaagcgatttaattattgccgttttttcaagaaaacgactttttaaattagcaattaactcacgaaaatcgtgtttgtgagctagttttgaaccaaaaactcgatgaactagtttaattctttgctcatatgactggattttttcaatgaaattagtataatttagcttttcaacattgattttttgctcttgttttgttttccaagaggtatattttctaataaaaaggtctttttcttcttcataaattgcttctttttgggccagtttttcttttaattcattgagtttttctagattttcggcttgcggactacttctttttttattatatgaatatttatttttaaattggagaaattttgtttgaaaatttactttttcttgataagtttttttacgattttgggcaatttcttttaaaccttgaatatccaaaatgataatttcggtacggattaattgactaaataattttgtatttgtataatttttttcatcttttttatcgaaagtcaaatttttatacttttcaatttgactttttttgaaattattcataatttcaaataatttttcaatctcagaaatattaagaaaggaaaaaaggtttttttcaagtaacaaaatatttctcctatcaagaaatttggcaatttccttattgattattgcttgttttttaaaaaatgaataattttttagatctgttgttactagcgctttgttatttgcaattttatattcataattaaattcgtcaatataggaagtcaacaaattgttttgagcggtgaatttgtcaatctcgagttgggcctctttttttaaattaagcgcttttacatttaatgttttaatgaaaaaagctttttcttgctttattttttttagctggtcttcataatcttttttagcactgcggtagtcaaattcgacttttgcttgctgtttttgtcggtaaattttttggacttcatagaaataatcatataatttggccacattttcatagccaagattatatgatgagctaaataatttttgtaatttttcaaaataaagcaaataagaattaaaaaattcgttgatttttgcctctgtgattttatcggtagaaatttgcgctaaattttcttctattttttcaatccgagattgccagaaattaatgaaatcttgaaattcaaagttacgtttttcgagcatttcaagttcaatttcaagatatttttgttctaaagttttggcaaaatggaaaattagatctgatcagtcaaggaaaatatcatccatttttgacttaattattccgttaattaccaaagtttcttttagaatggaataaacatttttctgtttatttagtgaagaaaatggatcttgaaagatcatctgcatattttttcttaagaaaagattctgtttttttgatagtttttttccagaaattacttgatttaaaagttgaacctgacccccaaaattttcataaaggcgaacaagacaacgaccaatcgaggtttttcctgaaccggattcgccaattagtgctaaaacttggcctttttttagctcaatatcaattccatcaacggctttaatagtcccaaatttgtttgtaaaatatttttctaatttttttgtttcaagagcaatttccattataacacttctttaaataattttattcttgtttttagttcttgatttagttcaacttttggagctttaggatggagcaatcaagttgcagcttcatgagtctcagaaattggaattagtggaggttctttttcaaaatcaagtgctaaagcatattcatttcgtggagcaaaaggatcgccggctcctaaattttttagatcagggggagaacctgtaattgtatatagttgattttctttgttagtcccttcaggaatcgccgaaattagcgctcatgtataaggatgtcttggatctgtgaaaatatcttggcgggttcctttttcaacaacttttccggcatacattatataaatataatcacaaaattttgcaactattgaaatattatgggaaataaaaataattgcaattttatatttttccctgatctcattaagtaaggctagaactgaggactgaacagttggatcaagtgctgttgtcggctcatcggcaataataattgaaggttgctgagcaattgtcattgcaattacgattcgctgtttcatccctcctgataaagtatgaggataagaattaaaacgtttagtagcattttcaagtccaaaagattcaagtaatttaatcaaaaagtctttcttttcttgaatatttttaaaacggctatcattttttagcgcatctaaaagttgtttaccaattgttcttgtcggatttagtgcaacaagtggatcctggggaatatagccaattttatgtcctctaatttgtcttcattgcttatctttttgaaaattagttacatcaattccatcaatttcgattttatctgcgctggttttagcaaaattattaattcctaaaagtgcttttgcacttactgattttccagaaccagattcgccaacaaaggcaataatttgaccctgataaagacttaaatcgatccctctgattacttcaagatattctttttttccagttttaaaactaattcggagattttttacttctaaaatccgctttttttgctgattttccattattttcttcccccaattcttggatcaaggacatcatggattccatttgcaataaatcgagaagtaactgcaagaattactaaaattattgaaggtaataaaagtgccattggatttttattagcaagtgaaactgatgaattaataataagacctaaattaggacttgaatcaggtccttctttaataaatcctaaaaaagcaagcgcggcaactgttgtaattgaagcaaaaatacttgcaataaaaacagataataatttcccgaaaatattagggagaatatgatagtaaatctgacgtaattttgaagccccaattactttagcagcatagacatattcttcatctttgaccattattgtatataatcttgcctgataagccggtctagttcaacctgtaagtgataaaagtagaatcaaagtgagagtattaggaccaaaaattgcaataaaaataataaataaaataattcaaggaattgatccaaaaatatcaataattcttaaaatcacattatcaattcaggtgccaatatgaaatccaaggtaggtacctaaaataattccaattaaaaattggattagagcaattataattgcaattcctagagcatttaaagttccttgtcaagttcttagtcaaatatccctaccatattgatcggttccaataattgagacaaattttttcccattttctaaaattgacattacctgataaggatttatttgaatctgccagcgatttgggaataattcaattgtatctcctttaataagttgaattttattttcaagttcaattgacctaattttttctaaaatatccgtggataccgttgtttttataagacctcagccacttggaagttgctcatttacaaggacaggatcggcttgtgaaatcggttttgttgaactataaggacttaaaattactgaaaaaattgcaataattaaaagcgataaaaataaaattgttgaaatcagcgaaattttagagcgaaaaaattttagaattgcatcttttcaaaactcaagtattcttccggttgaaatatagtttttctcagaaaaacttgcaggttttaaaagactaatttgctcttttgttagattatagcgctggctaaattcttttgaactaggcattatttttctcctttcttggataatttctgattttccaatttttaattttttctcatagacttattggtgatttattcccaaaactaattcgtggatccatgaaaagatagacaagatcgccgatgatatcaacgattaaagaaagcgaggtaaagaaaataattgaaaacatcgaaatattaacctcgccatcaaaagccgcgcttactaaaatacttgaagaccccggaattctaaaaaattgttctaaaacaattgatcccgaaaggagaattatataagaaaaaattagcgatcttacaagtggaattgctgcatttttaaggacatatttaaaaaatatgtccatttttgatagcccttttgctttggcaattaaaatatattcagaagataaaacggtaattacctgatttcgaacaagaaaaacataacctgcaactgaggtaatcgaaaagacaaaaatcggcggaatcagcgaggctagtgcagttgagatcccataagttgaagggtctttgaattcaaaaggaagaccaattttaattgcaattaaaactacaaaaggagctaaaacaaacgaaggaattgctacaaaaaaagttgagatcccactaattgctgcatcttcgatccgatcgcggcgataagcagcaactgttccaagaataactcctagaaaagcactaattaaaaaagatggaagagaaactaaaattgtataacgtaaagggccaaaaaacaaactaggaatttgaccatcttcaccggttttataaatcgggccaaaatttcctttaaaaacttctgctgtataaaatcaaagtcgggctaaagttgattgatcaaaatggtattttgcccgtaaatcagcaagttttttcccttgatcggctacttttgatcctttttcaactaaatcaccaaaaggatcaggagaaaaattagcaagtaagacaaaaacaattatataaattgctaaaaatgtaatcaaagcaagtaaaagccgtttaaaaaagtatttcagcgccattatttttctccttttttattatttttttcccatttttcttttaaaggtttaatgacaatcatatctgggggtgtaaatgcatcataagtatcgtttgcattgggaatttccaagtttggattttgtaaaattgcataaggggtagaagaaaaaacgctgacaagatcgctaaggccaaaacctaaaagcgaggtaagttcggcacttaattcaacaagatcctcatcagaattttcttcttgaaaagtcaaattaaaaattgctgattcagctagaaaatcaaaatcaattaaatcacctttatttttgtttttagcattaagttcttcgacaaagtttttccaaactttgattttttttcctggattttctggatcatcttcttcgatcacagacccaattatataatttgttaaatccggggaaaaatgttgattatgcgcgccaaaatcaggggcatttgtagcatcttttcattcttcaaatttgcgtattcaacctttttttgcaaatttatcaaaaaaattttttgctgcaagggcatatttataaataaggggataagattttgcaatctcagaattttcgcctcttagataaattgctgaaagcattgcatagccaatgccgtttctttgaatttttccatctaaaaccgttccgattccgttatagtcataactccaaccgccaaaatcaagcccgcccgtgcgggtatataaataatttgagcgtcttgcaaggtcagtaattggtcagattcgcttgattttaagtcggggatcgagactttcgattgcatcagcggcattatttattgctgcaattgttttacttccggtatcagtatataaactatgactagttcattcaactttttcatttgggccaagtttgttatcctgtcaaaatttatcaagaatttttttcattctttcttttaaaatgtcaaaatttggtgcttgaaattgttttttgccgttttttacattggcaaaattttgttctctttcggatttaggatctttttgataataaattttacctgtagcatcaactaatttaattgtatttactttttggtaaaaatcacggggtgtttttgattttggatttgaatttagtttattatccggggagataaaattatatcaggcaagttgttgggaggtaattgcttgtgaggttgtatataaatttcaagcattagcgattatctggcggaattccaaacttggacctgaaatcaagtgttcaataattttagcactaccctcagcgatttctttaaggggaacaccaaaatttaatctagcaaaattatcattgaatccatagtatttctcatcaaaactcacacccgtttcggccttaaatttctgccttagagagcctggaactaaaagagaataataccatttatgaaggtcgtttttactttcttgccgatttagtgttcagccaaattttgcttgattatttgctaccaaatttttctgggactcactaagactatcaaaaccgattgcattaattgtctgttcgcgataagaattaaactgggaatctgcaaaagcagaagcagatggatattttgaataaagaacattaattttcttaaaaatataaggaaaactttcttttcaaccagtccggggaaaatattcattgatcattcaggattgtttatgttgatcaaaaactgttggaagataaggtgaattataaagtaaatcctttttaaaatcctggccatatcaataagccccgaattttaaagcatcgcctgtttccccaaaacggcctactaattttccatctttttcttttgcaagttcttttgttcttttatcaataaaatcggaaggaactggtctaagcatccctgaaagaacgattttatcaataaaaccattgaaaaaaaccttttctttatttgctcctttttgaaaagtaagtgctttttggcctttaaatttttcaagactaccttgatattcctgaatatatttattttcatcatctaaatcttttggatcaaggccaaaaagttcaaggagataaaaattagtaattgtattagtaaaataatttgattttggatcataattaggaattttttcctgtgctaacttgtcaatttctggacttccgccaaatttttcgcgctcacttggaaccgaaagtcgctgactgcgaaacccatagaaataatcccgcggttttagataatatcctgaaggttttccatcccaagtaacccagtttatttgatcttttagaaaaaactgaacttttttcgctttttcaagcgaagcagcaaaaaattcggaattaattgaattttttgctgctgaagtcaattttattactaatgacttcggtttttgacctggttttagataacctaattcatgttgatcactatcaaaaactagttgagttccatcattttgagtaaccaaaattgctttaatattcacaagggcatttcaggaatagcttggttggcttggttcatatataaatcgcttgtcttttttggtttgatcagctgctaaaacaccgtttttttcaatttttagttcattttcataaactgtttggatcaaaaatgaattattaaaataaagttgtgaactagtcaatggcgatgtgaaagtgttattaaaacttttaaaagccccaggtgaagaagttgcgctgttaacattaatattaaattcctgccgctgccaggctggctgaaccccgcaggataaaaaactaactaatgaagtaatacttaaaactgagccaataaatattttacccacttttttctccttttttttttttttttttactaaaaaaataaaaaaactactattttgaatagtagttttaaattttaaatggtgaatttactatatcaaaacaaaaactactattataaataaagcaaaaatctaacattaaacttgcgaataatgttattttttactttatatttataagtaaaatttgtctgcattgtatttcctgtaaagctattatagcactttttttaaaaaaaccaaaaaatttcaaaaaattttttttcttggtttttttaaattttgttttataatatttaaaacaaaaattgaaagagtagtaaggccagcccaattgcaatttttgcttttatatattataaataaggtggaattataattttatattttccccgccggaaaaatgatcctaagccttgcttcagctacttttgtaattggggtttctttttctattaacgaaagtatatgtaaaaattctaataaatcaaggtaaaaataaaaaacctttgtttttatagtgttttttaaaatattatctttagaaacaaaaaattaatgccggttttttagaaaaacccataaaagatttttaaataaaatttcaaaaatcttttatgtttttaaaattattaaaaaaaattatatttttgttaataattttaaaaaaacgaaaagaaccaagaaattactaagaaattaaaaactgcttttttaattaaaaatcgcaaaaagcacttaaattacagcactttttttacttttagaattttaggacaaaaaaacaaaaaaatttttttaaatttcttattttttttgatataatttaaattctaaccgttttggatttttttgaaagctttgatttttattttttgttctttgagttttagtttttccataacattaaattatgctaaatgaaaaatttccttttgtttggccgtttttaatatataattataatgtatatttctaattatgaaaaaccttataatttatagtatattttaataactagggaaaacaatatgtcaaaaattttagcaaccccaaaagcaagagcgatggcaaaacatgctaatattgatcttgctgatcttaaaattcaacatcggaaaattgaagcttccgatgttgaaaattacataaaatccttaaaatcagcacaaactagtgctgaaaaagtagaagtttcatcgtctcagcaggctgaaaaaacttctattcccgcgtcaattccgcctaaattagaaggaaaacgcgagaaaatcgctccaattcgaaaagcaattgcaagagcgatgactaattcttgaaattcagttgcctatgtcaacctcgttaatcaaattgacgttagcgatctttgaaaacttagaaaatcagttttagaccctgtcctaaaaacatcaggtgtgaaactaacatttcttgcttttattgccaaagccattttgattgctcttagtgaatttcctgttatggcagcaaaatatgatgaagcaacaagtgaaattgtctatcctgatactttaaatttaggtcttgctgtcgatactgacgccgggcttatggttccagtaattaaggatgctcaaaagctttcaattgtagaaattgcaaaagaaattgttcgtcttgccaaagctgcccgtgaacgtaaaattaaaccaagcgaaatgcaaggtggatcatttacaatcacaaattatggatcggttggttcactttatggtgttccagtaataaattatcctgaactggcaattgctggagtaggagctattattgattcagccgaggtcaaggatggtcaaattgttgcttcaaaaattatgcatttaacagttgctgcagatcatcgttgaattgatggtgcaacaattggtcgttttgctgcaagagttaaagaattattagaaaaaccagaaattttaggaatcttataatgtataaatttaaatttgctgatatcggtgagggactacatgaaggtgttgttgcccaaatttataaaaaagaaggggaaacagtcaatgaaggtgattcgcttttttctgttgaaactgataaaataacagcggatattccttccccaaaaaccggaaaaatcgtaaaagtcttaatggcagaaggcgatacaatccacgtcggtcaagaaatttatcatatcgatgatggctcaggagctgaagctgaagttgaagaagcaaaacctgaagccgaagaaaaacccgctggaggagccagtgttgtgggcgaagttaaagttagtgatgcacttttaagctttgattttggaccaaaaaaagcaaaaactgcttcagcagaaaaagttttagccgcttcagattcaaaaaaagttgaagacaaaattgaaaaacctacaaattcaggtaaaatttatcaaggtcagattgaaaaagaatttgatgtaattgttgtgggttctggacctggaggttatcttgctgctgctgaagctggaaatgccggactttctaccttaattgttgaaaaagaattttgaggtggagtttgtctaaatgttggatgtattccaacaaaagcaatgttgaaaaccgccgaggtttttgattatcttgatcaatttagtgattttggactaagtggaaattctgatcttaaaatttcctgagaaaaaatgcaccaacgaaaaaccgaggtggtaaataaattagttgggggtgtcaaggcaattgtaagatcggcaaaagcaacaagtatttttggtaaagctgaatttgtcggggcacgtgagattagtgttgatggtaaagtttatcgtggaaaaaatgtgattttagcaactggttcagttgatcgaaaattaaatctacccggttttgataagggttatagatctggaaaaattattacctcaaaagaagccattaatttagagcaaaaaattgattcaattgtaataattggtggtggggtaattggtgttgaattcgcccaaattttttcggctgccggaattaaggtaacaattttgcaaaatctgccaagattattagcaaatctagatagtgaaatttcgcagataattactaaaaatttagttgataaaggtgttaaagttattacaaataccaacattcttcgttttgaggatgatcaaattatctatgaatttgaaggtaaaactgagttaattaccggtgaaaaaattcttgtaagtatcggtcggcaagcaaattctcaaggtcttgctgaggttggaattgaacttgatagtcgtggtagtgttatagtcgatgatcaatgcagaacaaatgttgatagagtttatgcaattggcgacctttcggctaaggcaatgctagcacatgttgcctatcgacatgcggttgtttcagtagcagcaattttaggtaaaactgaaaaatatcaagaaaaaacagtacctgcttgcgtttatacccatccagaaattgctgtggttggtttaaccgaagaacaagcaaggcaagccggccatgattttgtcattggaaaagcaagtttttctcatattgggaaagcaattgcttctggaaacgcgtacggatttgctaaattaatcattgataaaaaatacggggaaataattggtgctcacattatcggcccggttgcaactgatttaatttcagagatcgtaatcgcaatggatagtgaagtaacagtttatgaacttgcagcggcaatccacccgcatccaacttatagtgaaattatttgagaagctgcgcgttctgcagttacaaaattgaagaaaattaaataaattataaaaaattcaatttggttttaaattcttaaaaacgatgtaaaaaacttttttgttttacatcgttttttttaaattaattttagcgcagattttttactttaatttgaaattaagttaaaaatgaaaaaacactataaattaatatactaacttaaaaaaaattaggtttttgttttttttaataaaaacctaattttttgttgtataatataaaataaattaaatttaattttcccaaacgctgatcgcatttttggcaattaaaagctcttcgttagttttaattacaaaaatatcaagatcggattcaggagctgaaattttctcaattggtccaaattctgggattggttttaagtttttttcttggtcaagaactaaatttaagccgggtatttgaactttttcgattaccagggaccgaataaaagctgaattttcgccaacaccacctgtaaaaacaagcgccttaatgtttttaccgaccttatttatataatttacaagataatcaacaattttttggacataaacttcaagggcaaaacttgcctctaaattaccactattttttgctgaaattacatcgcgaagatcagaagatacccgtgaaagccctaaaagtccggaatttttatttagtaaatgatcaatttcgctaaaagaaaaacttgcctcatttgccaaatatggtataattgatggatcaatatcaccgcttcgagtccccatggcaaccccggctagcggtgtcattcccattgaagtatctaacgactgtgaatttttaattgcgcagagtgaaattccattaccaatatgcatattgacaaaatttaccttgtcagagtcataaattttttcaacttgtgtggtaataaatttatgagaaatcccgtgaaaaccgtactttctaattccatatttatcagcaatttcggcattaattgggtaggtataattgatttttgggatagtaccatgaaaggcggtatcaaaacttgcagccagttttgcatttggaattaattctttaactgctttaattgttgccagggcgccgggattgtgcaatggcgcaaattttgcagctgcttcaattttggaaattgccatctgatctaattttgccggagctttaaaacttgccccaccatggacaattctaaatccaacaagttggaattcttcaagattttcaacaagctgattttccttccaaaaggcaatttggactgctagtgcctgactgtgatttgcaaaattatctttgtatttatagtcttttttgccaaaagacattttgattagaccatcttcaagaccaattctttcaattaggcctacacctaataattcaagattttccttttggaaaatctgccatttaattgatgaagaaccagcatttactactaaaatttttgctttcactatttaccttcttcaacttgtagagcgctaattagcacggtattaaagacatcttgagttgttgatccccgggataaatcattaattggggcattaattccggtaattattgggccaattgccccaaaatttcccaatctttgggcaattttatagccaatatttcctgcatcaagattcgggaaaattaaaatattggcgtttttacctacatttacttcatatttttggcggcgaacttcaatatcaagggcggcatcaagctgaatttcaccataagcttcaattggagatgttgcattaaacatttgcgtcgctttagccactaattctgactgcggtgattttgctgatccttttgttgaaaaggaaagaaaagctggttttggatcaaaacctaactgaatagcaaaatcaagggcatttttagcaatatcaacaagttgattctcatttggagcaatatttactgaaatatcactaaataaatatttttcctgatctttatgcataatcattactgatgaaattgtttttatatttggttttgggccgattattttaaaagctgcgcgtaaaatttcggctgttgggtaattaagacccccgacaactgcatctacttttttctttcttagtagcattgttccataaaaagcatttgattgaaattgaatttcggctgactcaggagtttcttttcccttgcggaatttaagaaattccttaataaattccattttttcttgaaaattaactatatgttgatcaacgtcaagatttggaatttcttcatcaactagtaaaaccggttttactaaatttttttcctttaaaagttttgccgcggcaattgctcgcggatcagcgccatcaataattagaactgagcgtaaactttttgtctcattttgttgctcaagtcttgcttgaagatattcttggtatgtcatgttttcctttcaagtcctagaaaattaacttttaaattttaaatcaagtataattttatacttttttttcgaaattttcataaaaaagctttaaaaaatctattgcttatttaagaaaattaatcaatatcttcgataaaaccaaaatttagatcattaggtcgtgtaaatttatttttcttttttagacaaatatataaggtatttttaaaatcatcatcattttcgaaattttcaatttcttcaaaatcagcaagtccaattgttaaaattttataataggattcaaaatattccctaaatattttaaaattcaaaacaatcataaaagtaaaaaatgtagcctcaaggatgataaacacagttaatccaagatttttatctataaaaattttactaaccaaatcagttttgagtcaatttgaggcaaaagtataaaataattcctcgataattgataaggttataagaataaaaaagagagcgaaaaatgatcagccaagaaatgacattattgccagatttttattcatcgacttaatctcttcaaaataattgaccttatattcacgcagtcggaaatcgtttgcataaggttttccgtcttttattgaacattttttaactaaaaaattaaaaatttgttttttatttgaacctataaataaacccagaggcataatacttaataagtcaaatccagcaactttttcggtgtttttataattaaattcttgaaattcttgccagaaattattgctaattaagaaatttttcctcacattttcaggttcgaaatggagagataaaccagaaaataaaaaattatttttcttaaagatacgtccaccttttaaaataaaaaataaagcaaaaagaaaaaaaataattgataaagttcaaaaaattcaaagaactttatcaagatttttaacaaaaatattaagatcagctattttttctccattgttttccagtcagtttttaaaatttatctctaaaaatagacctattcctaaaaaataaaaaaataagcttaaaaaaaatacgattttaagcaaaattaacttattttttttaattttccggtgaaaaaataaaacatattttctaatctcttcacgttttttcatattgttaatagttgtttttcaattgacttgttattaccaaattagttaaaactgaaatagctgagactaaagtatcaagaatacttattattgcacctaaaggatttgcatattttatcgttgttagaacaccgcgttttaatttccctgcaatttttagaccatcaactattttatgagcagaaaaaaatgcttttttaaataatgattcagtaacaagatcacgtaatactgtatttgttatttttcttcctagtatttttgaaaccattactttcattaccttttcaattgtagttttaattaaataacgtactgcagatgcttgagttgatatatttatgatattataaaaaaagataaaatcagggtctttattcttcaatttggtttttaattcgtctttaaattcttcaaaattcatcttttatttttgcatcgtttagaaaatcatcaatcaaattctcttgttttagttttgttgtttttatatttgtatcagttttttgagataaaattctttcattttttggtggggttggcgggtttttgtgtttttcaggatttggttctattttttcttggatatataaaacattttttgggtgtatatcaagttcaaaactagaacttgtatattctaaatatttatctaaaacttctattggagttattttttttagttctaattgcctctaaattatcataatgatcaaatttaaatcttgtttttaattgcaaatcatcaatattttctaaactaaaatttaaaaaattttctattcctggataatcgtcaaaatcaacattttcaatatttccctgcatttgtaggaattttttttcaaattctttctgcgcataagcgccatcagaaattgacatttttaccggggttatttcataaatttcttttggcaaaaccattgcaggtcttggatttcttccttgaaaaatatccatatttgcaacttgatagacaggggctaaaacccctggaagttgggataaatcacctaaattaaatagaattttcttcataaatcatcccattatttataatttttgctagttgatcaagctgataaaatttcttttccatttcttctcctagcgccttaactatacctagaaaagaattattttttgaataaatttcaaaaatattaaatccgagatttggacttcaaaaatagattttctcttctttttctcttcagaatttaaaccctttattttctaaggtaatttttagattttcactaaaaaaatttttgtcaataattaaaaaattttcattatcacaaacattaaaaccgaaaggaattatactatgctttaaataaaaaacaatattttttgaagttgttattttgaaaaatgtagaaatatacatagtaccaaaacaaaaatcatcaaatacataatctaaatctttttccttaaccacagatcaatattcttggctaatatttttgatttttaattcgttatttgatgctaaaatttcaaatttttccacgttttcaaataaaaaaccgctctggtgaaccattttatttatcgatcaagaattaaaatcaaaaacaaatttcctttcacgataaaccgtttttaagaaaaaacaaattaaagatgaaaaaaatgccactataccagaggaaagagcagtatataaaataatgaaaattacattttcttcatttgtgccagaatttttaagaattagtacattaaaaagtagaacaaaagttattaatgtaaacattaccgcaattcttaagaaaaaattaaaagttttatctattttttttaatcgaaatccaaccagcataaatctttgtcagtatttatcaagtcggtattttttcattatttctactaaaatattatttgaatttgtattttccataatctaaaattttacatttttttataacaatttttaaaaattaccctttaatttatagtatttttttattttttagtctaaattataaaattatcttgaattttatttgaatttttataatttagtactaaaaaatacaaatattttttcctattctaagaaaaattcattttttaaaaaaaattgatttttatagtataatttatttgtataattgaattaacttgatttgaaagggaacaaaatgaaaaaaatgcttagaaaaaaattcttgtattcatcagctatttatgcaacttcgcttgcatcaattattgcatttgttgcagcaggttgtggacagacagaatcaggttcgacttcagattctaaaccacaagccgagactctaaaacataaagtaagtaatgattctattcgaatagcactaaccgatccggataatcctcgatgaattagtgcccaaaaagatattatttcttatgttgatgaaacagaggcagcaacttcaacaattacaaaaaaccaggatgcacaaaataactgactcactcagcaagctaatttaagtccagcgccaaaaggatttattattgcccctgaaaatggaagtggagttggaactgctgttaatacaattgctgataaaggaattccgattgttgcctatgatcgactaattactggatctgataaatatgattggtatgtttcttttgataatgaaaaagttggcgaattacaaggtctttcacttgcggcgggtctattaggaaaagaagatggtgcttttgattcaattgatcaaatgaatgaatatctaaaatcacatatgccccaagagacaatttctttttatacaatcgcgggttcccaagatgataataattcccaatatttttataatggtgcaatgaaagtacttaaagaattaatgaaaaattcgcaaaataaaataattgatttatctcctgaaggcgaaaatgctgtttatgtcccaggatgaaattatggaactgccggtcaaagaatccaatcttttctaacaattaacaaagatccagcaggtggtaataaaatcaaagctgttggttcaaaaccagcttctattttcaaaggatttcttgccccaaatgatggaatggccgaacaagcaatcaccaaattaaaacttgaaggatttgatacccaaaaaatctttgtaactggtcaagattataatgataaagccaaaacttttatcaaagacggcgatcaaaatatgacaatttataaacctgataaagttttaggaaaagttgctgttgaagttcttcgggttttaattgcaaagaaaaataaagcatctagatcagaagtcgaaaacgaactaaaagcaaaactaccaaatatttcatttaaatatgataatcaaacatataaagtgcaaggtaaaaatattaatacaattttagtaagtccagtaattgttacaaaagctaatgttgataatcctgatgcctaaaatttctaaaagttaaaaatttgatcttattttattaaaaattaacataaaaaattagcttaaattttatataatttacctaataaaatttagagctaattttttatttatgaaaggatattaaattgaaaaaaactaatattctatcactaaaaaaaataaaaaaagtttatggtcctgtaattgctctttctgatgtgacttttgttgttccaaaaggggaaataactagcctagttggtgaaaatggcgcgggaaaatcgacacttttaaaaattttatcaggagtgattcctgctggacaatatgaaggtgatctaatttttgaagataaaattatggcttttgcaaatacaaaagcctccgaacgtgtcggaattgcaataattcatcaagaactttcaatttcaccttatttatcaatttgcgagaacatgtatatcggtaattatccgactaaatttggcaaagttaactgaaataagatgatttccgaatgcaaaaaatatctagaaatggtcggtcttgatgaagatccaacaacaattgctggctctctttcgattgcaaaacagcaaatggttgagatcgcaaaagcactttcaaaaaatgcaaaactactaattttagatgaaccgacttcctctttaaatgatgaaaatgcttttcgcttacttgatattatgaaaagtttaaaaagtaaaggaattacttcgatttttgtctcccataaattaaatgaagtcaaatatgtctctgataatattgttgtaatccgcgatggtaaattcatttcccagtataataaaaatgaagaaataattgatgaaaaccggctaattcaggacattgttggccggcctttaaagtccaaatttcctcctagggatttagatcgaaaaatcggggaaattatttttgagatcaaagatatagttattcctcatgctagtattgcaaattataatgttgtcaaaaatgcttcccttgatgtaaaacaaggcgaaattgtcggaatttccggacttgttggatcgggtcgaaccgaattaatgctttcactttttgggcagtattataacaaaccttcaagtggcaaagttttctataaaggtaaagaagtaaaatttactaacacaaaacaggcaatcaaatcgggaattatgtatgcttccgaagatcgaaaaaatgttggtctaatccaaattttttcgattcaaaataatatcacttccgccgctttgcatttattttcaaaatgaggaattctaaataaaaataaggaaataattaatgcccaaaaactaaaaaaagatgtaagtattaaaacaaaaaatattctaaataatgtcgaatccctttctgggggaaatcagcaaaaagttgtaattgccaaagctttaagcaccaaatttgaccttctaattatcgatgagccaacaaaaggtattgatgttggctcaaaatacgaaatttataaaattttactagacctttcatcacaaggtaaaacaattattgtaatctcttcggaaattgaagaacttttaggaatcaccgatcgaatttttgtcatgtcccagggaattatcaaaggtcagataaaaacttctgaggcaaatcaagaaaaaattatgcaactaagtattgggggtcttatctaatggaattttttaataattttaaaaataatttaaaagattttgcaaaaccagttaaaaattatctaaatgagacaaaaagtggacattatcttcaagccagcctccaccatctaaaaaaattttcaatgttatatatttttcttctggtttttgttatttttttagggattaccaaaggaactttattacaagcaaatacattcacccttttatttcaaaataattcttatattattattttggcaatggggatgctacttgtaattttaagtggaaatattgatctttctgttggaactcttgtcggtcttttaggactattttcggtttatatttataataataccggccaaagtatttgactaacttttatacttacaacgctaatcggggctgcaattggttttatccaaggctgacttattggttatggaaatatcccggcatttattgtaactttaggtggatttcttgcttttaaaggggctcaacttgtctattcaaatggggcaacactgactccaattggatccgttgattcaacttatattaagggaacaattgaaggaatccctgatctaaaagtagggaatatttgaattttttctttacttttacctctaattttaggcgcaattattgttagtctgcgaacttgaggatattatacaaaaagaaaatttggcattaaagttcaaaatattattatttttacaataattcaagtaattattttttctttattccttgcttgtggtataatattttcacttggagataaatcaatgcgttactatgttttatatgtaggtattgcactggctttatttacttttcttagccaaaataccgcttttgggcgctctgtttatgcaattggtggcaaccggaaagctgctctattatccggagtcaatgttaaaagaacaacaatgataatttttattatcattggcgcactagccggattttcttcgattattttcacagctacttattcttctgcgacttcttcgcgaggtgatgatcttgctcttgatgtcatttcagttgtctttactggtggagcttcagtctatggtggaattggatcggttagtggaacgatattaggaacatcaattatcggggtaatcaaccaaggtttgcttgttctaaatgttgccgaatcacaaaaatacataattaaaggactaattttagttgctgttgttggatgagatgttctctcaaataagaaaaataactaaaaaaatctttaaaacaaaagaaaataagtcaaatttttccttttgttttgcttgtgaaaaacaacaaatccattttttcaatgaaatttttattgaaaaaatggattttaaacttgttttacttgaaaataaaaattatgaaattattaatttaaattttaaatacacaaaatcgcaaaatcaacattttcttccttttgaagtcagccataaatttttaaaaattcaaggaagtatcattatcacttttaaagccgatcagataataattgaaaaaagaattaatgcaaataggaaaatcaaaactgccatcaaaaccaaaattattcttgcaaatcaagtaataaaaaatctagaaccagatcaagttttaacaaattttcaatcttatcaggttaattatttttcttcctatcaaaactgaattcttcaaaataaaaatgaattaattgatctacttgaaatccaagatactagaaaagctcaaaaaaattgaaaaactactaataataatataaattatcatactatcaaaataaaaattggactaaaaaatgataaaatataattttgccactatcgacatcggcggaacaaatacacgttttgcaatttttagtgataataaaatcacaaaaaaaattaaatttgccactgatgttataaattataaaaaaattcttgataaaattcttgatctagttagccaatacaagattaacgcaatcgccttgtgcatccctggtccggctgattatcaaaaagggattattctctcttcgcctaatttaataggctgaaatggaataaatattaaggaatatctcctaaataattctaaattagaatatgctatctttgaaaatgatgcaaatgcaatggcatttgccaatcatattttttataaaaataccaaaaaaggcgtaactcagttttatacaatctcaactggttttggtgctggactcgtaattaataataaaatttttcatggtgctaatggttttggacaggaaattgcacatattccaacctcaaaaatatttaataaaaagcatcatctaaataattatgcagctgaattatttatctcgggaacaggaatgtctttaagagctaaagataaaaacttagaacaaaccgaaccaaaaaatattatcgcactatctcaagaagataaaggctacagacaaattgttggcgactgtattgataccttggcgcgaacaatttcgataacaattggaattttaaatcctaatttgatggtttttggcggttctatagctgagtataatttttgaataattcaaaaagcgatcaaaaaagcgaaacagtgaacaaataaagaccaatgagaagctataaagtttgaaaaagatccttttggtgatgattcggctttatttgggctttactacctaatattagaaaaaacaaagaaataaagctaaaaataggaaaaaattaggaaaaatcagctatttttatcttttttagaatttttttgcatttttgcctaatttaggtagaatcaatttttgttttcaaaatttgattagctatgattttgccgtatttactattaagacaaaaacatttgtatcagaatgcttttttgttcaaattataccttagttatttaatttataagatttttttgtttactgtttacttcaaaaaaatcttataaattaagacctagttcattaaaaacatcctctcatttggggttattttcattcgtaacacaaagaaataagttatttttataacgctcatttttttcaaaattttcaattttttcaaaatcaataagcccaaatgttaaaaatttataatattcaattaaataaggtcgaaaaattcctgagtttcccagtttgatggcaaaaattcactttttagtgaatatgaatatgcagaaatccccgtaaatcggtgttttttacccgtaaaaccttaatttttattaattacaattaattacaattttaaagtaattttatggtataattataaattatgaaaaagcataatttgattttgtttaatgtttgaggatcttcaaaagataaaatatataaatatgttggctgaacacaaggttatgggaaagctccaaaacgttgatttagtataggaaatgtgcaaactttggaaaaaattaatccaaatgctattcaaattatcaaagaaaaattgaaattgttttcaaatttagatgacaaagataaaatcaagactactttacttgattctattaaaaattccgccataatcgaaggttcggtttttattggtggggaattaattgaaaaacttattgaaaagcacaatatttttgaatcacttcctaaaagtagacataaaaatatgaaacaaatttttaactacttaatttcaaagcgaattactgatcctggtagcattattaatgcttttgataaaaaggatgattactcaaatcaaataaatacttccaaaaatagcttttatagactcttagatcttgtctatgaatcacaaaatcaacttttagatagtcttaacaaaatggttataagcgagcttggaaaaagggacaatgaattttattttgatgcatcaacagtctattttgagacatttgaaggaaatggattaagaattcctggctattctaaagatgctaaattcaaagaagatcaaattgtcattgctttagcatgcgataaaaatggcattccttttcatattaaagtttttaaaggaaatacagccgattctagtacgctaatcccttttgtattagatattgaatccaaatataatatcaaaaatatgacaataattgctgaccgtggcatgtccactgctgcaaatattcgatttcttgaatcaaaagaatataatttcattatttcttatcgtgcaaagataggcagtcaaaaatttaaaaattatttattagatcctagcgattatgttgatgtaaatgcagattttaagtataaaaaagaagaattttattcatcttataaaaataaaagatacactgaaaatattagaagaagaattattacttacagtaaaaaaagagcaataaaagacagcaaggctcgcgaagagcaaatccaaagttttattaaaaaacaaaataaagatggttttattgaagtaaacaaattgtttggtaaaaaacctaaatattttagggaaatttcaaacatgaaatttgaattagatcaaagtaaaattgacaaggacaaacaatttgatggttactatgtctatgaaacaaatatactaaatttaaatgtcttagacatagttgaaaaataccaaaaacagtgaaatattgaagctaattttagaagtctaaaaggtttattgaatattcgtcctgtatttttaagaatagatgagcatatcctagctcatacatttttgtgctttatctcattagttattttaaaaactataatttttaaaatcaacaaacatattagtgataacaagttatttgcaaacagtcaattaactgaagttggtttagtaacgatgttgcaaaaattaagacaaagggttgaatttaacactttagatcaacaaatgatatttaaaaatcgcgatggtgttcctagtgatcccaatatttgaaataggtatgatttctactttgatatcttaataaatcagtaaaaaaataggtaattaacttttggcaaaaaacttaaaaaagcacgggaaaccggacacttttttaaaattatctcatcaaactgggaaactcgggaataagcccaaatgttaaaaatttataatattcaattaaataaggtcgaaaaatttttgaattaataaaatacaaaacaaaacaaagaaaaaccacaaaaaaaacacttaaaattgaaaaaacaatatttgagtatgacaaagttggccccatttttactttggaaaccatcttaacagacttgaaactatagaaaatgatagtttctagtacactttgcaaaagaaaaacagaaaaaagggagaaaataattgttaaaataattcaagataatactgaaaaaataaacaaatttaagggtttcttctttattttttgaaaataattaactttgtaatcttgtaaaatgagataaccttcatataaattaacatctttaattgaacattttctcgttggaatatgacttgaaattttctttttttgttttgaagtaaaaataaatagaccattataaaatgattcaaattttgaaattgtcaaattatcattatattcaaaattatcaaaatcttttaataaattattagtttttaaaaattctttctttattgaatctatttcaaaatggagtgacaaaccttctaataatttattattttctttaagaaattttctgcttttaaataaaaaaaatagagctaaacaaagaaaaatgatggttaaaatacttaaaataataagaaaaatattcataattttgattcaccgagcaagattatcaaatgattttccatttttaattacaaaagatttaaaatcaaattttataaaaagggtcagtgataaaaacaaaaaaaataaaattgaaaaaattgaagaaattaaaatatcatttttattttgttttattttaaaaataaaaaaagctacatatttttttattgaatcatttttggtcataattttccaaatttcatttaaatataattatcttcttattgattattgataatagcagcaatctcatctaaaagttgaaatttgacttgaacttcctcatttattttttcaattatttttaaaaaagaaggtttttcaagaataatttcaaaattataaaatggtttattttgattttgaaaaactaatttttcaagtttttcttctaaaaatttaaatttattttgctctaaaagtttcttatttttattattaataaatttagattcaacaactaaaaaatttccgtttgtaatacggtcaaaattcgaaaatatttgtgaaaaatctagataaaaaactaaattttttgatgttgttattctaaaattaaaatcaatctcaccttcacctgcaaaaattaaatatttttttgctaataatgataattgtggaagagttaatttatttactattaccggctttttagtaatatcagggattagttcaactttttgaatatttttaaatgtaaattcaatttctgaaataaatttttccatcgccactttaccaaatttcatctcaaatctacgttttgggtttaatcaagtaattataaaactaggtaatgcgaaaatagtggttataatccaacatgaaatagcggtgtaaataagttgccaaattgcaaataaacggttttcattggtggttcaatcagaggaatatgttctaagagatgataattgcaaaattattacaattatggtaaaaatagccgctaatggaagaaaaatagaccaaaaaagctttaaaataaagtatattctatttaattttttagttaaaaatttccctcaataccacttaaccttcttctcgtgtaaaccatatttgcgtaaaatttcctcaactattttcctatttttctctgatttcataattttgtcctaatttgaagaaaattaaaaataattataaatttttggaaaattctttactaaatattgacttttcatcaagactagcaaaattcttatcaaattccttaaaaaatggctcattaatagacataattctagtaggtgtcataaaatcaatttggggtataactacattagattttggatttttttccttaaaaatatccatatttctaacttgatagacagggactaaaacccctgtaagttgggataaatcacctaaattaaatagcattttcctcataaatcacctttggaatttataatagctgctaattcatctaattgataaaatttcttttcaatttcaagttttatattttgaattatacatcaaaaagaaggcttttcaataaaaaattcaaaaatattaagaggtcaattagggtttaaaaaatgaaattcttcgcaatcatcgtttaaaaatttgaacttttggttttctaaaagtgacttaattttactattgataaattttgagccaataattaaaaaatttttatccccgtcaagcttataatcatagaatatccgaaaatattttgaataaaaaactaaatttttttgttgctattttaaaatgtgaattaacaatacttttattatcaaaaataaaattctaatctgtaagtataatgctcttaacctttgaaattgaagttagttttaatttttcgattaattcaccctgttcattatcaacaactacttcaacttttttaacatttttaaagttaaaattcatttctgaaactattttttttatcgatcaggaatcaaaattaagactaaattttctgcctggatttaatttagaaaaaataaaacaacctaatcataaaataatgccgataataaaacaagaaatagcagaatataaaaattgccagattagaaagtttttatagtcaatttttagttttacagagtccttatgtaaatataataagggaaataataagaaaaataaaagctaagagcacaaaaaatccaaccagattttaaaattgaatataaataattcaatttttgagttaaaaatttttgttgccttttccgaaaaaaccttttatttattgaatattttagtaaaatatcttcaattatcataatatttttatctttgggcatatacaaaaaaccatcaactctataatttaaattttagtatattttttatattagattaaatctaattttcttaataatacagataaaatatacaagtttagcttttttttaggagtttttaacaaatttatgttgataaattaaaaaaaattactatctttggttattaaaaagatgtgcttttaactttgactaataaagtcccggttttttaaaattttttagtcgcctaaatttagttgaaattaaaaaatcttggaataataaattgatatatttttttgatataaattaatataaaattcttgcattttagaaattaattttaaaaattttcttaccaagccgaatatattcatcaatttgggtttcaagaagtgaaaatgcttctgtataaattaaagaatccccaaggtcaatcccggctttttccagaattttacttggtcaatcagagccaccttttgaaaggaagttttcaatgtaattgtcaagggcttttttaccttcttttttatatttttgaaagaaagcattagcaacaagatagccaattgcatatttataaacataatatccataataataatgtgggacaattacactataaacaagcggtttttcatcatcaagtgggtcatttggattatatttttgtagaatttgcttataaattcccacaaaagcttcataagaactaattggttcacccttgtcaattttattatataaaactgcttcataatccgctcaaattacctgacgttggacagtcgcaataaaatttgaaatttgttgagataatatttcaaatttgaaattttcatcaccttgtttttccaaaaggtagtcatcgagcattaactcattaaaaattgaggcaatttctgcaaggaaaattggatatgagctattatgataattctggtttttatcagaataataagaatggagcgaatgacctaattcatgtgctaaagtatgaactgcgtttatagtaaagtcataattcattaaaatatattttttttcaagcccatatgaacccccaattgaataagcaccagatctttttgaatcaacataatgatagtcaattcatctttggctaaatgctttttctacaacatctttatattcttgacctaatggtttgattgccccaagcactattttttgtgcatcttcaacagaataattattttttgtctcaactaatggaactaaacggtctcaactattcatcttagtcccaaattttgcttgataaaatttttcttttgcttttttgaatttttcaaaaataggcgctgaattagcgacaaattgaaataatttttctaaacttgtaactggaaaacgatcagaactaagacttgcctctagcagtgattgataatttcgcattcttgcatccacagaacttgacttaatatgctgatacaacaaatttgcaaaggtgtttttatgttcaagataagctttatgatagtttatatatgcattttttcgcactaaaggagaccctgtttttaaataattataatagtttgttgaattaagaggtaatttcttattttcttcgtttagaacatcctgaaattttgtttctgaatttgaaagaattgagaaaattttataaaccgaaatttcaccaaaagatgattttgtaagataactttcaacctcatcagcaagtttatgttttttattatcaagtcgataatttagctctttttgataaggttttactcttaaatcgttgattcaagaacgaattttatcctcatttttataaaaaataacatcaattgagcctaattttgactcaaattcagacatcaagaaactaaaacgttcattaatttgactaaaaacaggatcaattacattgacgctgatattgtttgaaatataattaagaattttattgtattttatcccaaaattagcttctagttccttatattcaagaaaattttcaacattttcaaattgttgatctttttttgatattaaatcattagaaatttcttgaatactagaaaaattttcctcaatagtcttaccttcaagtagcacatctaaatcaaaacggtatttctcaggaatttcagaatattttttatattgcattttatttaccttctcaaaaatagaaaataattttttagtatttatggtataattttttctcggtaaaataaaacgattaaaattctttaaacattttaaaatcgagtataattattttaaatttttattacctaaatatctaatccaataaattatagcataaaaggtataaaaaacaaaataaatcattataaaaataataaaataatcaatagaaaaaagagaaaaatgcaaaaacctgatttttctaaagcttttaaaatctttttatcatattcttcttgcttaacttcaagtctagctcttttatcctgttattcttccttaacttcaaatcgagatagcagaacaccaaatcaaaatgaaaacgagttaactgacaaaaaaaacacaaatacttccaatagatttaaaaataacgtaattttgagcgaaattaaatatttaacacttggcgattcaatttctgcagggttcaactgggactatagttttgattttcggggtaatattaacaaaaatttgaaaattaaaggactttcatatgcagcattttttgccgattttattcaaaaaattaaaccaaatgcaataaaatcctttgataatcttgctctttcttgaacaacaattaaggactggctttatcttttagattctgaaaatgaaaaatttcaaaattttgacaagatacgtttaaattttaattacgaacttgataaattaacaaaatcaccttatggaaagcaaattcgtgatgtttttggtaatttttctgctaaaaattacccaaaattaaaagaaaaaattaaaaacgctaatcttttaacagtctctcttggcgcaaatgatttaatggaatcaattgattttaaaacaattgcaaaacccaaccaaaaaattgccactaaagccgaagctgctgctgaatttgttgcaaaaattaatttagctattgttaaattagaaaaaaatttaaatatatttattgaaaaaatccgaaaaattaaccctaatttagaaatagttttagttggttataacattttgttttcatcttcaatgaaattttttgataaattattgacaaacgagctcggtcttcctaataattacacaattattgcacttaagcagttaaatgaagcggttaaaaaagtagctcaaaaacatgggattaattttgttgacctttataatgaaagaagttggttagacaaaacaaacaaattcgcaaaaaatgaatttgacattcacccttcaactaaaggttataaaaaaatggcacaggatttattatttaaacttgccttagagcagggtcctaattttaaaactgattattttgaaaaactagactgaaatcaagaatatttcgaaagggattctaactgttataagcgagttttaaatcttgggccaaattcagaaatttttaagactctaagcatcgataattcagtcaataagtttattactaataaatctgaaattgaagaaattagtagtgctgaaattgaaaaggttaagaattcacaacttgcaattctttcaagaatttgatatgaggtgagttttggaacttttattgatggttttttacggtcaaatactcaaattagtgaaaaattacgggaaatgttgattaatttttggcaacaaaatgcaaaaaataatccttctttctccaaacttttacatcaatttttacagagcgatttttgacttgagatcatcggtcgatttcaaaattacataaatgacgtaataattaatcaaaatttagaaaaagccacaatttcaggactaactaatttcctttttaccgactttagtgagaaaaaactaattagcgtttttaaggatgcagttaattctgattttgccagtcaaaatattaataaaattaaggaactaatttttatttgtgtttttggacaaagtgcaattcaggaattattaattaacagtattatcggaatttcagctgaatataaaagtgatttacaggtaatttttagttttgaatcaacccgaaatttatttacaaaaattattaatgattttgttttagaatcggcaaaatatgaaaatgttaataattttttagatattcttaaaattttcctagataaaccaaaaaattacgaaaatattgtaaaattctcacgaaattttatctctgaaagtttaaaacaccgcaaaactgtaaactttttagtacaaattattaactcaaactttaatttgaacctatctgaagatgataaaaatgcattaattagtcttttactttcagtttctgatacaattattcgcacaaaaacttgagaaaagctaaacaatgaaggtgctaaaagttttttaaatattgttaaaaatactgattttagacatactagtaagaaaatttccacaattttaggtagtcaggttcaaggcacttatgcacttttttttaaaaatactacaaatttaataaatttattgcatgaacttttatcatttgatttgagcaactatcaaattgaagtactaaaaagattactaacaaaactatatccattaatttcaaaatttaaattaagttattttatttcgacagattcaccaaattataataatttttctgtttttttcaactctgttaagggttttttaattgaaaattcttttcaaatattcaacaaaattattagtgaagcaattaatgattttgttgttaataaacttttatatcaaaaaattggaaatttaaatcgttttggatttgaattcctaagaaataatttagaaaaatttgaagaaaatatttttgattttttagcaaaatgtgtaaataatattgatttttttacgaatttgtcggacttaattaacaaatcgcttcaatctgaagggctttcacaaaaatcagtgctaactttctccaaaatcatcaaaactatttttgatgattttggagaaaaatataaaaataaacaattgaataaaaatgaacaagatgaaaatttgatttttattttggtaaaggaagcaataaaaagttttaaaaattttaccaacgataattttaataaatataatgagctaaaagtaaatttagaaaaagcagaagatgaaaaaaataattctaaaatcaatttttataagacaaaaattgatgaacttgaaaataatttgtcaataataaatttctcaaattttttcctaaaaaacttaattgaaactgatataaaatataaaattttaaaaaatatcgcaaaaattaatttaaaaaataaaattggtagtcaggatttaattttattttttaaagatctctttagtaaatcatttttacacaaacaaattgtttctaacctggagaataatagaattttcggaaaagaaggggttaaaaattctcttttagaacttttagttaactttttcaactcaaatcaggtagaaaaactacttgaaaaatttgttgattacttttttgaatctaaaaaattcgaaaaaacaacagattttacaggttttgttactaattttataaaggaacatgctgaattaattgaaaaaattttcggcctttttcttggagatactgcaacctgaaactcactctcaaattttttaatgtcgatttttcaagcttctaagattaatttatctgaaaaagcaactaccacaattttgactttagtacgtaatatttttacaaaatgaaaaaattcaaccttaaattttgaaaataaccaaaaaaaagaatcgcccttagttattcaagcattaattaaaattatttttgatagtttttctgataaacatactcttaccaaatcaatttttgaaagcataattgatagtttaagtgttgatattgcaaataattattataaaaagaatgaaaatagttgatcaacatcagatcaaattagccaaaatgaaattgcaaacttatttgctgaaattgcacaaaccgaagcaatttccgaaaaaataaagtcaaattttataaatattcatttagaatatagggaaaaaatacagcaaatttttgatgcatttttaaaatctaatgcacttgttgagttatttgacggatattttaaaataattgcaaaagccgaaattaatgagccgctaaataatttttcattggttaaatcattatttgaaaaccaatattttaccaaaattattggtaaatttattataaaattggaaaataacgttaatttaaaacaaaattttaccttattattaagcaaaatttttaacgttaattttgaagagaacgaatttgaaccactttttaaactaataaaatacataatccaagataatattaacaattactatagcaatgaagaagatcctaaaaattttctctataaaaaattgactaataattcaaatttatccagtgaaaatactagccaaaataatgaaaatttaggcacagaaaatagcgaaaatactataaaatacggtatttattttaaaaaaaatgccctactaaccaaactagtatctcttatctctaaacttgcaaacacaaatctatctactgctaatatcaattttattttagaaaatgaaatcggaaatgaagaatttattatcgaatttctaaaacaaattggttgtgtatttgataaaatcaccaaaacagatcaagaaaaaatttgggaaattctagtaaaaatttttaaatctaatttccttaagaaaggaattgaatttttcaaattttctaattttaataaatacaaattgtttgaagaattaagcatacagaaaaaagaacaaattaattcagcccttagaagtgctatggagaactttcttcctaatccagtaaacaaacttttaatttttagaatttttaattttattaaccaaaatcccgataaattcaaagaaattagaaaattttcagggttattaactgaatttctaaaagataatcaaacaagttctaatatgcaagagaatcaaaagcttactgaaaaaattgacaattcagcatttttaaagtcatatttatgatatttaataaattttttagtcaaaaacgaggaatttagtcagcttattgttagtcaaattcttgaatatttacatttagatattaaagatgaaaaaaattcttacctaaaaacaaaaggaatttctaatccagaagaaataataaaaaattttttaaaccattttataaatctgggatttgaaaataaaataattgaaaaaattcttgaccaaataattaatagtgttaaatctgcccatttagaagcaaaaagtaattttttcgataatattttaacaaatttaaaattatcagaagtactaaatttagatttacttgttaatttagaagaaaaaattactgatgaaaaaacactaaacaataagttgcctcaactagaaccaaaaattgatgagcataatttaataataaatttgccgcaaaatcagcaaattcctattgattcatttgttgattttttagaccttatttttctagcatcaccaaaatgaaataaggaaaagcaagctgaagtctccccacttctaaaagaactaaacaatataacatatactggaatttcatttgccgatttgttaaaatctaaccaaagggatctaaaacttgaagcgatttcaaagttattttcaaaaatttatagtgaaaacatcactaaggaaaactataaaaatagtgctagaggtcgaaatttatatagatttttattaatgttacttttttatgcttatgaatcacgcataaaaaatagtccattgaggacaagtgccttttatgggtctattcttagttcatccactgcttcggaaatgatcctaaattcgctaaaaaatgcaggaaaaaatgaaaaaaatagtcaaaaatatagtgaatttatcgattttttaaaaggaaatccaattaaagttaagggttgattaataaatacatggtataccgcaaaagatgtacggcttgatgatatgttaactttaatttattataataatgaggataatcggtttaaaaacgaaactgggcaggaaaaacttaaagaccaaattcttgaacaaatcagacaaggtcatttccctgacaattttgaaaatccaaaaataatttctaaataagaaaaattatacactaaaaaaatttatttcaaaaataaaaaacttcagtttattctgaagtttttttatgaatattttaaattatttttaaatattaaaaattatttaataatttcggtaactgttccggcacccacggttctaccaccttctcggatcgagaatttggttccctgctcaacggcaattggggcaattaattcaacggtaagatcaacattatcccccggaattaccatctcgcgacctggttcaaactcgattccgcctgttacatcggtagttcgaaaataaaattgtggtttataatttttgaaaaatggtgtatgccttccaccttcttcttttttaagggcataaattgcagctttaaattttgtatgcggtataattgtttttggttttgcaatcacctgaccacgttcgatatcttttcgatctactccacgtaggagaacaccggcattatccccagccatcgcagtttgaagatttttattaaacatttcaattccggtgattacggtctttttaggttcttcgcgataacccacaatttccacttcttcgtttagtttaacttgacctctttcaacttttcccgttgctacggttccacgtcctgtaattgtaaaaacatcctcaacggccatcaaaaagggtttatccatttcccgaacaggtgagtcaatataagaatcaactgcgtccatcaattcaagtacttttgcctcccattcaggttttccttcaagggccccacgagcagatccccgaataattggagtattatcgccatcaaaatcataagaagaaagaagttcgcgaatttcgacctcaactaaatcaaccatttcttcttcgccttcaagtaagtcaattttattaaggaaaacaaccatttttgggacaccaacttgttttgataataaaatgtgttcacgagtttgaggcattgggccatcggttgctgcaaccactaaaattgctccatccatttgggccgctccggtgatcatattttttatataatcggcatgacctgggcaatcaacatgggcatagtgccgtttgtcagtgctatattcaatatgggcggtattaattgtaattcctcgtgctttttcttcaggagctgcatcaattgaggcataatcctttgcctccgcgagtcctctttttgccaaaacagttgaaattgctgctgttagtgttgtttttccatggtcaacatgaccaattgttccaatattaatatgttctttggaacgatcaaagtctttttttcctgtcgttttaacaactgccatattttttcctttcgcttatcatttattatatcgtaattatattatattatattattgttttaataaaaccttgcaaaaaaccaccgctgaatagccttgcaactatttcctatcctttttttgcaggtcggattaaaaaaaaataaacattttcaaaaataatttttaaaatgattctttttataattataccaaaatttgaaaaattattttaagaatttttttaataaaaaaataatttagaaattttacttaaaaaccgcagtttttaaactgattttattttttaatagttttcctatttaaaaataaaatcataaatttgttgataagtatcaacgggaataaactggattacgtcttttacctcctgcggaatatcgactaaatttttctcgttcgcctttggaataaaaataattttaatcccatttttataggcccccatcgtcttttcttttagtccgccgattgctaaaaccttcccgcgcaaggttatctcccctgtcattgcaatattatgtgagaccggcttttgcgagagggctgaaattattgctgttgcaaaagttatccctgctgatggcccatcttttggaattgctccttcgggtacatgaatatgaattaaagtgttttcaaaatcaaaattaatcccaaaatccttggcctttgactgaacataagaaagggcaatccgggctgattcttgcattacatccttaagcgaacctgttagtttaatatcgcctcgtccgggaatcgtgcttacctcgatctgtagagttgatccgccaagtggtgaatatccaagtccagttaccgttccaatttggggacttgaatcgacattatctggatcatatttttcaatgcctaaaagttcacgaacaaattcaatatcaattacaaaattttgatctaatgttttctcaagtaattttacaataatttttcttacaattttatcaattactcgcttaagacccctaacaccggcttcgcgtgtatagtggcgaatcaaaaagtcaattgtttgatcctggattggaaaatattttggatctagagcattttcttttaaaactgccggaattaagtgggattttgcaatctggattttttcaataaaagtatatgaagataattcgataatctcaacccgatcaagtaaaggctcaggaatatcataaatttcattggcagtagcaacaaataaaacttgggaaagatcatattctaattcaagataatgatcctggaaaaaacggttttgttcaggatctaaaacttcaagcatcgccgcagatggatcccctttaaaatcagctcccattttatcaatttcatcaagtaaaattaagggattggaaactccaactttttttagggcttgaataatttttcccggaagagcgcctacataagtacggcgatgtcctctgatttcagcttcatcacgaattccgccaagggaaattttgacaaattctttaccaattgcttcggccaccgccattgcaattgaagttttcccagttcctggtggacctactaaagtaagaattggaattgaattacttcgtactttacggattttatgacttaaaaataaatttgaatcaatataatctgaaccaactttttccaattcgggtttgccttcagattgcgagcgcctatgaattaaggcagcaagatattcaataatccgcttcttgatttcatcaagtccataatgggcttcttcaagtttttctctgacatttttaatatcaagaatatctttttttaccttttttcaagggagagcgactaaaagatcaagataacttttggtgatatttgactcgggcgaggttactatcattgactttagtttgtttgtctctcgcataattgtttttgcaacctctttagggaagacttttttccctagttcggaatgaagaagttcttcgatctcatcttcataacgggaatcctccccgagtttttttctaattgctttaattttctcttttagaataaattcagtttgttgtttgtctaaatttgtttttagaataacattaatttcatcttctagtttaatttgctcagcaaatgtatgaatatgttcgtataattttttaatttttgctggataagagttataagaaaaaagttggtatttctggggataagtcagacttggcgagcatgataaggtatttgttacaccttttatatattcgtttgtactatattcagaattagcaccaaatttatcaacaattaaaagtaattcagttggaattctaaaattttttgcttttcgggccatctctaataaatcattgatcaaatttatatgaatttcgggactttttatggtttcgcggacaggttttattataatttggccaacttttggattttgaggatcgttgattagctcgactaattggactttttcggttacaataaaatctaaaattactgtttgtcattcacttttatctggacttgtttttgcccgataactctgaattcttgccaaagaagcatattttgaaagctcatcaaggtcataaatgcgcggtaaaaggctattttcaaaatcaccaacttttccattaagaatttttgcctgattttgaatatcattttttgaatcttcaaaactattaaaatcatttcttggaaattttataacactagaattcttttttttagtatctttttccttctctttacgataaacaattaaaaaatccttatttgttagtgttggtcttgaatttgaatgataaaaatctttgagaactttaatcgattccggatcgctgaaagtaatagattgctgtagggtattttgaaaataaatgtcctcagaagcgactaaaaaacgataggaattagttggcatatttaaaaaatctccatttttgttttatattttatttaatacttgatgacaaaagttgcttaaatgcgataattataccataaaaaatcaacaaatttaattgctaaaaaacaaaaaagaaatttattaggaaaattaagttacttttttgttctagttaaaatttttatttaattttttactctttttgataagaaataatcagcaattatatagattggcaaagccaaaaatgattccagggaataatttgctaaattaaaaggggcaaaagcgcttaaaataaaagttcaataagaaagtttcagccctccaaatttttccctaatctcagaccaatgctcaatcatttttaataaagaaattgattcagtaagtttatataatttaaaatacaccggtgtaattaaaacgccatttaaataagtcattaaaaatgttgtaaccaaaacagcaaaaattagtgctaaaataataaaagttttagttttttttgagtttataaaaatcttttttaataaaaagcgaaaagataaaaaactaaaaatataaatagaagaagctaaaaataaaataaaatgaccaaaataaacaatatcaattccgccaaaagtattaaaaattagtcaaggtccaattgaaaaacgaattaaaaggcagataattccaatcccaaaccccgaaattaaaaaaattgggataaaaaaaagggttgaaagatcgactttaagacctagattttgaaagaagggccagctgaaataattatgcgaaaaaattaaaaaaataatcgaaagtgaaagtaaaattccggctactgttaatttaaaatttaaattagaacgccaaaaaattgaattagccatatttagtcactaaaaaaacgatcccctgcatcgccaattcctggaattatatatcctttattgtttaattttggatctttttgacagaaaaatattgaaatttgcggatatcgttctaatattttatcaattcctacctgaactgttaacatcgttgcaatcactatttttttatatcctttttcaagaattatttcaattgcacggattaaagtattccctgttgctaaaataggctctaaaacaatcgcaactgaattaggatttgcttgtggcaaactttcaaaataagtctgaattgataaatctgaatttctttttaaaccaattggtgcaactttagcatagggagcaagttcaagaaaggagtcaagcataccaaaaccggcccttaaaatcggaataaaaacgagttttgtaataattttatgacctaaaaattcatgacctaataccgatttagctctaaattcttctgtttctaatctagataaaactggaaaagcaagcaattttgatatttttttaatcgaattgcggaaatcttttaacgttgtcatttgccttattctagcaatttcactatcaattaaaggatgatcaacttttatttccatattaatttctcctttaaaaattgtttttttacaaaacaatttttatttttttaaaatagttgtattataacataaattttaaaaaaaataagttaatattcattttttttatcagtcaaatttttgataatacttactgattttgaggtgccaaaccttgttgccccaagtcggtaaaaattttccatatcggctagatttgtaattccgcctgcggctttgattgccaatttttcgcttttgttttctttgatgatttttaaatcctgttcacttgcacctcgataggaaaatcctgttgaagttttaataaaatcggcattggttgaactaactaattttgtagcatcagcaatttcatgaggtgataaaagggctgtttcaataataactttaagaattttagtgccgatttccttcttaatttgattaatttcgttaatgataaattgaaaatccttctctttaaatttaccaatattcatcaccatatcaatttcatctgccccatgagcgatagcaagtgaggcttctttttgttttattgcactaatttgacttcctaaagggaaaccaattactgttacaattttaatattggtatttttaagctctttttttgctaattttactcaaattggcgcaatacaaattgccccaaaattatattttttagcttcttcaattaaaattttaatatcctgagaagttgcctgtggttttaaaagtgtatgatcaattattacgttaaaattcatataaattacctaatttttcttaaaatttgcccaaaaatactatttttttcttaaaattttcatttttgtaaaagtttttagctaattttatttattaattttagttattataccacgtttttatacaaaatatttatattttggaattttttgctgccacagacataaaaattaaatcaatgataaaactataaaagttgcttttaaaaagttttgataaattttataataaaaactaatttttaatttaaaaaatgtggtataatataaattaaaatcatttgaaattttacacttgtttttaaggtcaaattttgactttttaaaaaaaataattggtaaaaatactttaaattttctatttgaaaattcttattaaaacataaaaaatatggtataatttatacttaccacgcgcttttatatcaaaaaggaagaaaaatgcttgaggagaaagacaaagataagtcaaattttgacaatagcgagttcgatatcgaatcaaatgatgaaatagatgatgaagatactaactataaagtcaaacccacaattttagaatcaataacagataatatttctccaattaaaattgaagatgaaatgaaagcttcatttcttgattattcaatgtctgttattgtttcgcgtgcacttccggatgtccgtgatgggttaaaaccagtccaccgtcggattctatatacaatggctgaactcggaattacttcgggaacaagttataaaaaatccgctagaattgttggtgatgttcttggaaaataccatcctcatggagatgcttctgtctatgaatcgatggtgcgaatggctcaacctttttctttacgttatcctttagttgatggtcatggaaattttggatcaattgatggtgatgaagcagcagcaatgcgttatacagaagctcgactatcaaaaatttcaaataaaatgattgaggggctgaaaaaaaatactgttgattttcggcctaattatgatgcaagcgaagttgaacctgaagttttaccagcaaaattccctaatttgttagtctctggagtctcaggaattgcggtaggaatgatgacaaaaattccgccgcataatttaggtgaaattattcattcctttataatttttgccaaaaatccaaaaattgaaattaacgagttaatttcaagtctaccggggccagattttcccactggcgcaacaatttatggtaaaaaaggaataaatcaggcttatctaaccggaaaaggttcttttataataagggcaaaagcaaaaattgagaaccttaattccggcagatcgcggattattttctatgaaattccttatgaggtaaaaaaaccagcaattattgaaaaagttgcatttttagttagaaataaaaaaattttaggaataaaggatgtccgtgatgaaagtagtagacacggaattcgcgttgtttttgagattaaaaaaggttttagtcccgaaattatcctaaataaactttatcatagtaccgatttgcaaattaattactctataaatatgctagcacttgttaatggtgtgccaaaattgatgaatttggcacaaattttcaactattatcttgagcatcaaaaggaaataaatctacgttcgcttaattttgacctcgaaaaagcaacagaaaaattgaatgtcttagaggggattaaagttgcagttgaaaatattgatgaagtaattaaaattataaaatcatcaaaatctgatcaagcagcccaggaaaaattagcgcatacatacaatttaaattctgggcagacaaaagcgataattgaaatgcgacttggacggctaacctcacttgcaattgaaaagttaaataatgaaattgaagagttaaaagttgagattagtgaaattaaatcaattattgactccccaaagaaattaattgatttaattattgagcaacataaaaatgttgttgctcaatttggtgatccaagacgatctgaaattattcctgaaattgattgcttagatgaagaagatttaatagctgatgagcaagtaattatttcgctaacacaaaataattacgtaaaaaaaatggtgttagatgaatatcgtctacagaatcgcgggggaattgggactttagcatcaaatcattataaggatgatgaactaaaatcattatgcattacaaatactctcagtgatcttttaataatttcctcaagtgctaaaatttttaaattaagggcgcaccaaattcctgatggctcaaaacaaggcaaaggaattccgattctaaatttaattaaattagaaaaaaatgagagtatttctaacttaattccttgaaatcaagaatatgataatcactggctaattacagtttctgctttcggaaatattaaaaaaacagcccttagtgcgtttcgaaacattacaaaaaacggaaaaatagcactaaaactagtcgaaaatgactatttagtctcagcttttatagcccctaacaatccggatcttaatattttaatcggctcatcgcaaggttttgttaatcgctggtcgataaaattattacgagatagtggtagaactgcaattggagttaaaggaatcaaactcgaagaaggacataaaataattggagcttgttttgctttcgataaccattttatttttagccttagcaaaaaagggtttgggaaaaaaactcaagtaggtgagtatcgccttacagggagaacgacaaaaggacttatgagtctggatgcaaaaaaagctggaaatctggtgtttatttccgcaataaaaaataatgaagaagcaataattacaacaaaaaaagggtttgcaattagaattgatcttgatatggtgccaataataagtagaaaaactaagggtgtaaaaataattactctcaaaaagggagatgaaattaccgcagttagtttgatcagtaaaaatgaaactgaaaaacagaatgaataaataaattataccacaacttttttgtattttaaaaaaattattttatatctttatttaaagaactctaaaagatgacctaaattatgtgattttagttcagatttaggaataaatttaagcgatgctgaattaatacagtagcgcctccccccgaattgttttggaccatcgctaaaaacatgacctaaatgcgaatcagcgttttttgaacgcacttcgattcgagttagcgaggcactaaaatccagaacctccactattaaattttcatcaattggttttgaaaaagatggccaacctgaacctgagtcatatttatatattgataaaaaaagtggagttccatctacaatatcaacataaactccttcttgataattattattataaagattatcaaaggcaggctcagtaaaattttgctgagttaccttgtattgcaattctgttaaatggtctaattttttttcttttttcatagtatttctttttgtaaaaaataaattatgctataaatttaagggttttttaaaaaatttaagatcaaaaaaattttagtaatatactatttgctgatcagggtttatcatatcatttttatggcgtgaacacaaggataaaaacataaacgtagcaattatatcaagccaagcgataaaaattcctacaattgcaattgtttttattgttgaaagttttgataataaaagttggttatttcgaatttcaagatcatcggcaagactgtttaatttaaaagcaaaaatcactagaactattcggtcggcgattgttaataaaattcagataataagcatcgttacaaatacgcctaatcaagacccaagatcctgttttaaatccttaaaagaaatatccacaaataaaattgggccaataaaccagacaagcaaaaaaatacctaataaaaattttaaccgaagtattaaatgagcaattcctaatcttcgaacaaataataattttctttttctttcttctaagtcaaaattcataatttaaaaattataacatttattttaagaatttaaattatttttttagaaaaataaaattatctatcccatcctaaattttttgccaactcgtttttataactttcaactcccggttggtcaaaaggatttaccccgagcaaataagccgacattgcacaagctttttcaaaaaacatcacaagatgtccgaaagttttaggcgaactatctgcaatttcaagcactaaatttggattatttccataggaagaatgcgctaatgtggttgctagaaatgcttgaaaatttatttctgatactgtctttcctgaaagtttattgatttttgtattaaattgcactatttttttaattccaaggtcaaattttggcttcttaatataaataatagtttgaaaaaaatttttactaccatcttgaataaactgacctagcgagtgtaaatctgttgtaaaaattgctgatgccgggaaaagacctttaagatttttaccttcagattcgccaaaaagctgttttcatcattcattaaaatagattagaaaaggttcatatgaaatcaaaatttcagttttataattaaaatttttatacatcaaaaatcgaaaaagcgcgtatttgtaagctaaattttgagaaattgagcttgttgaatatcttttatgtgcttctattgcgccctgaataatttcatcaacattaatttttgcaaaaagtaaggggaaaaatccaactgatgataaaacgctaaaccgaccaccaatggattcaatgacttcaaaaatttctaattcgttagactttgcaatctctaaaagttcacctgattttatacttgttgttacaaaagttcttgtttttgcgagcttttcaccaatttgatctattaaaaattgatataaaatttgaaaagtgatggctggttcaattgttgaaccagatttagaaattacattaattgcaaaattttttgtttttaaatattctattttttggtataaatcagttgatgaaagcgaattgcctaaaaaaataacctcgggtttgttttcaaaagggcctaaacctaaaataaaatcaagagccgcttttgcacccaaatatgagccaccaattccaatgactaccaaaacgtttatggaattttgatgtaaattttccactatttttctcattcttgcaatttcttgagggttaatagctacttctgggaaattatttcaacctaaaaaattaatatcaggactatttttgtcattgattcggttgtgaaattcattaatttggttctgaaaaccttgataatctagtttaatttctgtttttacttctaattttaagctcattttttttccttttttagaaatttaggaatttttttatgtatgatgaaggttttttgaacttaataactaccatttgatcataaaaaatcagttttaatattaataattatacacctttttagctatttttgctaatttttagtcaaatatatttacttgcgccctcttggatattttatcaaaaatacctaattccttgagcttttttaatgatgtactatttgtttcggttctcttttcaaaatcctcaattgatgaaaaaggtcttaaattacgagcctgcacaatttttcgagcattaacatcaccaataccatcaattgcaataaatggcggaattagtgaattattttctttgttgattattcattcctgagcttctgatttctcaagacttaccttttcaatttcaaatccacgggatttaagttcaagactaatctctaaaaattggattaaatccttttcttttgcacttagttgctggattcccttttgactttcaagtctttttttattaagaatactaattttttcgcgaattttttctactggttgaattaaagtttcaagatctttaacatcaggccggattgaaaaataagaagaataaaaagcaagcgggtgataaagtttaaaatatgcaatttttcatgccttcattgcataagcaactgcgtgcgccttcgggaataaataaccaattttctggagtgattcaatataccaactaggaactttttttaattctagtaattctttttcctgatctgttagccccttgccttttcggacattttccataatattaaaggcaacttggtggtcaatatttttttgcaaaaggtagatcataatatcatcccgacaagaaattagctcgttaattacgtgctttttttctaaaattagtttttcagcattatcttgtcagaccccagtaccatgtgctagaccacaaattgcaacaatatctgcaaatgattttacttgtgcaatttgcaacatttttcttacaaattgcgtcccgaattccgggataccaattgtgcctgtaacctcaccaagaatttgatcggaactaattcctaattctttacatgatctaaaaagtgaaagaatttttggatcagatttaggaatttcatcggattttatatttgttaacttttctaaatggagcaaaatagttggatcatcatgccctaaaatatcaagttttaagagattatcatgaagggcattatagtcaaaatgcgttgtttttcagtccgatttttcattatttgcaggatagttaatcggggtaaaatcctcaatttcttgattttgcggaattacaataattccgccggcgtgtttgccagatgttcgtttaacaccttgagcttttgttgctaaaaaatcaagaaaagcgctggtaaaataagaaacttcacggttaagatcaaattttggatcaagtctagcgcggtattcccctaattttcgagctaaaccataaacagttttttcagcatttgtaagaattgttcccgcccgaaaagttttattaattccaaataaagttctaacaaaatcatgcatttttaactgagtctggcccgaaaaattaagatcaatatctggaactttttcaacattaaatcctagaaaagtctcaaaaggaatattatgcccatctttttccatttttttataacaatctaagcaatttttatctggtagatcataacctgataaaaattgctgggatttaggaaattccactttgctacattttttacatcaataatgaggtaaaagtgggtttacatcggtaattcctgttagaaaagccacaattgaagaacctactgacccacgtgagtcaactattgcaccttgtgatttagcctcagttacaatatgcttggaaattcaataaaccacgtgaaaaccctggtttattatcggttctagctcggttttaatgcgattttcaattaattttggcaaaaatctgccatatttttcataggcttttttataaacaaattcttttaattttacctcagaattatcaaaactgggtggatataagccggatttaataatttgaatattgttttcaattagatcagcaacaaaattggaatttttaacaacaatttcctcaattagttgctgatcttctagaaattcaaactcttttttcaattcttcagttgaaaaaaagtgtttttctggaaaaatatgactattgcgaaaatcttctcgctctttttcacgatgatcaaaaaggacatgattcacgccgccgacacctttggcataaatataaagttcataaaaaattttttcttttggcagacagtagcgaacatcgccaattgcaacagcgggaatctggagtttttttgctaaatttattaaattttttaacatatcttcaatttgatctttagtaaaaatttctctttttactaaatgtataaaagcacttggaggcggaatttcgataaaatcaaaaatatgagcaaattctgcaacatttttagggccaaaataaagcattgtttgaatcaaaagcgactctgggccacctgaaccaattaataaatctggatctttttgtaagtgatcataaaaaattaatggtcgagaaattagattttctgtattagccagcgaaactagtttgtataattttttaattcctatctgatttttagcaattatggttaattgttttgggaaaactttttctggacgaagctcgaaaattgagttttttatttcagaaagtgaggttagatcattaatattttgactttttagctcagctaaaaagttttttcaaatagttgttaaaatttttgcatcataatcagcacggtgggcaatttcttcatcatattcaatttcatatctttttgctacatttttcaaactatgacttttttcatttggattcaaaaaacggctaacttcaagtgtgtcaataattggattttttaaggatttttttgctttttgtctaaaaaactgttctaaaaaactaaaatcaaaggcagcattatgggcaactaaaactgaatctttgataatttttgtaattttttccagtgcaatttcccaagaaattgccgtttcatcaatcattttctggctaattccggtgatttttgtaattgcaggcgggatttttcctgtaggtttaataaaaaattggtgcttttcaatttcaataccattttgtaatacgactgcaccaaattcaacaatttcattataaaaagctgaaagtccggttgtttcaaggtcgaaaatcacaaattttaacttatcaaaaatatagttttttccgttaaaattaataactttttcaatttttgaacgatatgttgaaaaagtggagccataaattggcttgatgttagttgattttattgcattataaaattcagggaaagcctgaactgagtcaagatcggcgattccaattgctaaataaccatttttgagagcatgttggacatattctttagcacttgaaattccatccattgttgattttcaagtacgcgcagcgatttcgacgcgtttaattttggcagtatcaagcttttcatttggaaaaaaaattgaagaatcaattcttttaatttcatataaatttaagtcaacatttgatttataacgtgatgtaggatcttttattttggctttaatatttactaaatcaccaacttttaagtcataattttgattttttattaaaaatttactaacactaactgcctctgtataatcattattattaaggaaaatttttaaaattagtccacctgttttagtttttattgggctaattttataaatttgagcatcaaattgcacgttcggatttttatgagaacggataaattttaagtctattagttcaaaatcaattattttcttatttctttcggaaaaatttgctaaaaaattatactcaagtgggcgcatcacagtctcaagatctaaattgaatttattttcaattactggcttttcttcaagtataaaatcaagatcaagatgaattagtccaaaatattttataatttttcgcatttttttttcatatttggacataaattcaaaactttttgcatcagaaaaaataattttaaaccgagatgcattagctcttataatttccttatcattaaaaaatcctttatttttcgatattccttgcattatcccgtttagatattctaataattgttgatcagtaaaataattttgttgaatttcaaagtcaaattcaatcttacagttaaatttggattgcctatttgttttttgaactaaatcgataaatgcacataaatcattaaactttggaagtgtagtttttctaaatattgcagaaaatatttgtgtttttaggctttgatcattgacattttctacagtttctgcgcttgttttttcgattattaccacatcatctcagtcatatggatttgatcaatttattaattgggaaaattttctgaattttgtattcatttttaccctctccttgtatttaaaaaacaaaaactaactaactgtaattacaataaatgagaatactaaaaatacaaaagaaatcgaatcaagccggtcaaaaattcctccatgacctttgataattttcgaaaaatcctttatttttaagtatctttttataattgagaaaaaaatatcgccgataattgcagcagaaggcaataacaaaattgtcaaaatttttaataatagatctctaccagttgaaatattaaaatcgaaattaagaattatagatattaccaaaatcaatgaaaaaataaaggaactaataaagccttcaactgattttttcggtgaaaaattaaaatttgtcctaaaaaattttttagcaaaaattgaaccaaaaagataaccaaaagtatcgctagttattggaatcgaaattaaaaaaatgactaaaaaaaagttaaaagtatttaaaattcatagtgatttaaaaaacaaagtcgatataaaaatgatactaaattttagtattccagcaagaaaaaatcctcctgttttttcaattttattatcaaaaaaactaactattaaagtaagtggaaaaataaaaaaaatgtgataatctaaaaattgccatttaattaaaaaaaatgctagatttcagtcaaaatttgcatcttttgaaaaactagtttcaattaaatcttttcttactggtaatacaaataaaaaaatacccaaaaatgctagtaaaaaagtatagattttttttgactgaaaatgattgaaaatctcaaaaagactataaaataaaagacaacctaaaaaaataaaggaaaaaatccgacctcaaaaaataaagtaataaccaataaataaagccgggaaaacaactactaaaactaaaaaagcaactaaaaacctgataaaaaaatcagctggtaattttttaggccaggataggctcattttaaattgtttgaattgcttttacttttttatcaaaaagttgatcaattttttctatttcagaattaatatttttctgaacttgaccaagataatctttttctaaatcctcagagaattcctctttttttatcagtttgttaatatcttgtcggatcagacgcattcttactttgccttcctcgtgaatttttttaagtttatgaattgcttcttggcgtttttggtgagttggttctggaaaaattagtcgaacttgatttgcttctttttgaacttgggcatcaatttttgcagctacaattgcgcttgcaatttcttttacatacttagtttcataaggttttactaaaagttgtaatggaagtggagcagaaattgaagcgatttcgttaattggggttaaaacatcataaaaatttactttaatataagaaattaactgtggatttggagctccaatagttactttctgaaaacttttttcaagataggaaaaaacatcttgagctttttcaatcaagatgtttttataaaaactaaattcaatttcgttcttcattatctaataaacctccgtgtgtttaatttgtcttttgattaatttagaaatgctatttttttctttaatatcaaaaattagtaatttaattttattatcacgagccattgaaaaagctgttgagtccattacctttaaatttttttcaataacttgattataagtaattttatcatatcttagcgcatttggattaatttttggatcagagtcaaaaatgccattgacattatttttgcccactaaaataatatttgcacccatttcggatgcaaaaagtgttgcagcactatcagttgtaaaaaatgggcggccggtcccgccaacaaaaattaaaacattgttatcttctaaatatttcatcgctttttccctgacaaaatactcacaaattcgcgggtctaaactcatcgaggataaaactcgagttttaattcccaaatcgcggaaaactgaatcaagggcaagcccgttcataacagttccaagcatcccgatataatcagcggtgttcctgtttataccattttttgccgcggaagtaccgcgtcaaaaatttccgccgccgataacaattaaaattttatgccctaaattctgtatttctttgagttgagaaccgatttgtcttacaagttcataatcgattgccagagatttttgtttatttgcaagactttcgcctgaaagtttaataagaatagttgagtccatattagccttaaaagtttcttttattatactttatttttgaaaaaaaatgtattaaaaaaaggaaaattttaggaaaaagttgcagattttattttttttgactaaaaaggccaaaaaaaattaaatataagtgagaaacaaggaaaaaggaagttagaaatgaaaaaaatttttaggcttttaggaggtttaggtattgtaatttcaagtccttttttcatttttagtcaaaaaggacagattatttctaatcctatagagcttaattttaattttcaagaattagctaataaattaaatttcgatcgaaaattaaacaggttataccgaaatgtcaaagtcggagttttaattgaagaaaatggcgataaaaataatattgactataataatttacaagcaatttttgaatttttctcgccaagttccgaacttgttatctatcgttttaaaacaaaagaacaatgacttgaaggaattaaacattttgaaactgtcggtattgaaatgcttattcatctatacaaaaaagaaagaacttttttagatgatttattttgaaaaaacggcgaatacatcaaattaggtgattttctggatctttgaagtgcaaaaaccggaattataaacttttttgatggcagcagacccccaggaaatgaagttaatagtcattttagtttttttgctaaaactgatgaccgttttaagacaaataatcaaatgctatcacatacaaaaatttttggcaatggtttaggaattataaaatcaaatcattttgttttgccagaactaaaatataattatcaactaagcccgcattcttcaaatatggaattttattctgcttttttactagcggcgctttttagtcaactttcatcaagttttgatagttatgaaagtctaaaagatcgaaatttaaaaattattactgctctagcattaactgcaaacccttcagagaatagcaatttagcctttaatggcactcatttaaatgaaggttttggatttataaattatactgacgcccattttacaatccaacaacaaaattatttatataataaatatgatggaagtgaatatacaacaagtccttttgaattagtaaagaatcaaaaattttcagcgatagttttttctgataaattcaccgaaagactgatttttggagaatatttgccaggattttcaggcatttttcacaattttcaaaaaaatatcaaattaattactaatgcatctttttacggtcttcctgaatttaaagtaaatgattttgatatttccattgaaattttccgcggtggttggcataaaataattgaggcaaattcaactatcagtccatatgataaaatcagttttaaagcttttgaagatggacaataccgaataaaaatttcaagtcaaaaatttttacctgacaaacaaagcaaatattttattgcctgaagaagatatccttctgattttgtaacaaaaacacactgaaattaaaacattttttactgttttgtattaaaatgttttatattatgaatctttttgttgatacaacaggtaaatttttagtggttgcgatttttgataaaaattttattttaattgattcaaaaattagtgaaataaaaaataaagctgatattctacctgattttttaggtaaaattttgctaaaaaataagttagaaatcacagaatttacaaatttttttatcaatttaggtcctggaagttttacaggttgccgaattggactcacttttttccggacaattgcacaattaaataaaaagaagatatgaacttgttcaacatttaatttattatcttttaaaatacttgaaaataagcaatattttattgactatagtgaaaaatcacaatttagcgcttttgcccaaaacggaaaaataacttctaaaattttcgaaattaagaaaaaaactgaaaaagcaagtcaagtaaattataatttaatttttttaaattttgataaagcaaaaaaattatttaagaaggaggttgatttaataaatatttttcctttatacataaaataaaggaaaaatattaaaaaaactagctaaaaatattttctaatttgctattttcccgagtttcccagtttgatgagataattttaaaaaagtgtccggtttcccgcgcttttttaagttttttgccaaaagttaattacctatttttttactgatttattaagatatcaaagtagaaatcatacctatttcaaatattgggatcgctaggaacaccatcgcgatttttaaatatcatttgttgatctaaagtgttaaattcaaccctttgtcttaatttttgcaacatcgttactaaaccaacttcagttaattgactgtttgcaaataacttgttatcactaatatgtttgttgattttaaaaattatagtttttaaaataactaatgagataaagcacaaaaatgtatgagctaggatatgctcatctattcttaaaaatacaggacgaatattcaataaaccttttagacttctaaaattagcttcaatatttcactgtttttggtatttttcaactatgtctaagacatttaaatttagtatatttgtttcatagacatagtaaccatcaaattgtttgtccttgtcaattttactttgatctaattcaaatttcatatttgaaatttccctaaaatatttaggttttttaccaaacaatttgtttacttcaataaaaccatctttattttgttttttaataaaactttggatttgctcttcgcgagccttgctgtcttttattgctctttttctactgtaagtaataattcttcttctaatattttcagtgtatcttttatttttataagatgaataaaattcttcttttttatacttaaaatctgcatttagatcaacataatcgctaggatctaataaataatttttaaatttttgactgcctatctttgcacgataagaaataatgaaattatattcttttgattcaagaaatcgaatatttgcagcagtggacatgccacggtcagcaattattgtcatatttttgatattatatttaaattcaatatctaatacaaaagggattagggtactagaatcggctgtatttcctttaaaaactttaatatgaaaaggaatgccatttttatcacatgctaaagcaatgacaatttgatcttctttgaatttagcatctttagaatagccaggaattcttaatccatttctttcaaatgtctcaaaatagactgttgatgaatcaaaataaaattcattgtccctttttccaagctcgcttataaccattttgttaagactatctaaaagttgattttgtgattcatagacaagatctaagagtctataaaagctatttttggaagtatttatttgatttgagtaatcatcctttttatcaaaagcattaataatgctaccaggatcagtaattcgctttgaaattaagtagttaaaaatttgtttcatatttttatgtctacttttaggaagtgattcaaaaatattgtgcttttcaataagtttttcaattaattccccaccaataaaaaccgaaccttcgattatgacggaatttttaatagaatcaagtaaagtagtcttgattttatctttgtcatctaaatttgaaaacaatttcaatttttctttgataatttgaatagcatttggattaattttttccaaagtttgcacatttcctatactaaatcaacgttttggagctttcccataaccttgtgttcagccaacatatttatatattttatcttttgaagatcctcaaacattaaacaaaatcaaattatgctttttcataatttataattataccataaaattactttaaaattgtaattaattgtaattaataaaaattaaggttttacgggtaaaaaacaccgatttacggggatttctgcatattcatattcactaaaaagtgaatttttgccatcaaactgggaaactcaggaatattaaaaaaactagctaaaaatattttctaatttgctatttttaggtaaatcaagcaatttcgaatcaacactaattacattatttttaaaagcagattttcgaattattaatggtttggaattagggttaaatttaacttgattaatttgatttgtctcaaaactacctggaaaaatttcggctaaaatcaaattttttgacaaatcaagttcggtgattttattatcaaaaaaggcaccagtttcaattgtttctagttttgttgcctgggaaaaatctactgtttctaaactgttttttgcaaaagcttgttttccaattgatgtaatagaagggggtaaaacgagcgtttttatattgtttccttgaaaagcgaaactcccaatcctccttaatttcattgcttttgaaaaatcaagttcttgaattttttcattttgatctaaatttgcactatcgacataaaaggcataatcatcaatctcaagcaaactttcaggaaaaattacttttttcagagtataaaaattaattttttcgggctcagtttttttatctttttcttgatctgtgttttttttaacgtctatctgcgaatttactttttgataaaaacgggattttaagctaaaaaatgctgatttttcaatcttttcaagtctagatgctgataaatcaagtgtaaaagtctttgtattttcatcaattattacatagggcgagtctttatcatccttgcttgctaaaagagtttcagcctgggaaattgtctcgctacaagataaaaaaacaactaaaggtaaaaaaattgggcttaattttaaaaattttttaaattttaccatagatttaaaaagtataccataaaagctaaaaaatcctaattttttgttcttaaattataataagtccgaatttgcgaagctaattcttcatcaatcggttttaaaaaagtgtaattaactacataccggcgctcattttcgttatcttttgttggcatatttccgtataaagtttgttccttttgctgtgacagatagatattcagtgcacgaagagaggattttttaaaaatttttgattttactttataaaaagttaggctttcagaatcagtaataattttatcttgttgatcaacaaaaacagtaatatcctcaccatcttcggcctcacggacactggcgccggcattattaaagtaaaattttttgaaaaattcaaatgattttctaaatgttggtgtataatttatataatcaaaatttgctaaaacaggaagcaaactatagtcaaatttaaatccttttccacttttttttataaatgtttttgttgctggattctcaagataattaaattttacctcggatttaatagtagcaatcatttgatcaacttcaagttcttcgcctttaaaaactccttgataaagtgagttataaactttattggttagttcttcagatgtatttttcagaattattcaaccatctaaaagtgttaaattatttttgggacggataattgcgattgtattttcctcttgaagttcttcgtaattatcctttgaaaaatgagcatcaagtgcatcaccattatataaaagtgctacatcttggtttaaggatgggtcaattattgcattaactagttcaagtcctgaagttttaaagacattgtgtctgaggtcaaaatagtcaaaacctgtaatttcagcaatatatttaataaaattatcaactaaaaatttatagttatctttggtaattttttctccatatttaccaattttttcactaccaattaagagattatcacgcattgcctcagttcattcaaaaaaactaaaaccgttttttgataaagttttgccaatccctgcaagactttggtcgttaaatttaattcctttttcttggatctgagatctaaattctggacttcagtttttttgaaatctacgtaaattaactctttttccgtccttttcatagtcaccaatgatataggcaattactttatcctgggtaaaataaggaataaaaaattctcaaaaacggtcttttattccatcattatcggtgtctaaatcctttttagggtcttccgcttgtttcataaactggtcatatttatcgatatgctcaacaatttcaggccgaaaaatttgctcgaaagcctgcctttttttatcaataaattcctgtttttcctttaaagataaattttggtaattttctggttttctaaaaacttttaccaaatctcaatttggaaaaagttttgaatagtcaattttttgcaaaagtcctttttgtgctaaacgagcaatttgaaagtctgaaccaacacctgcaattgtccgattatcctcgattgcttttgtaaattcactgatatttccaaattcccggtaattaaaatccttgttaataaattcgcgtccttgatcagatatataagattcataattataaataacgggtttaaatccaaactgtgattttaaaaaaaatgctataaaaaaaaggataattagacaaataaaagccgcgaatttgccaaaaagatagactaatttgtttttcattttccaccttttttagtcttataataaatccagataaaatttgaaataaataggaaaaaaagcataatagttcctaacatcaatgctcaagttttaaaagttccttggtataaaagtgtcccgactgtttgtgcatttgaggtaatttttgtaataataaaatcatcaaaagataaaaaaacaacaacaaaaaaagtcgaaattatcgctggaaacatatgttttagataaattaaaaatcaagctttagttttagaatagcctaaatcctgggctgcttcgtataaattaagggaaaatttttcactttttggaaataaaaggagaattccataaggaaaagtcattacaatgtgtgaaataattgcccgatataaaccttcactggcagccgaaagtgaaccaaataaaaaacttaaaattgttgcaagtgaaattgctgtaattacatctggattaattagcggaatgtttgagcttaaaactacataggtttttattgttttatttttttgtcgccagagagcaaaaactgtcaaaagtgaaagaaaaacaacaacaattgctgcaaaaaaagcaataattactgaattaataaaagcgctagcaaaactttctttgctaaattcatcaaaagcatgcaaggaaaatttatttaaagtatttgaaacaaatcctttttttgaaggtgaattaaaagaaaaaactgccccgacaataatcggaatataaaaaagaataattaaaaatcaaacgtatgattttttcaaaatttcatatttttggaaaaaatcaataattttagtcatatttaaatcctttaattttcattataataataggaataaaatgaattagactataaattccaataaaaactagcagggtcaccaaaacaagcgatgaaacccgggcaagatcaaaaggattggaaatatttgcagaattattaatcaaattgccaattaattggttttgtgatccatttggtaaaagtttatctgaaaccacaattgaggtagctgccattaaaaaaacaagcgcaaaaccggaactaattgcccgaaaactataaggaagaacaacttttattaaaagtcaaaattttgaataacctaaatcagtcccggcttctagtaaatttttgggcatatcgcgaaaaattgtatataatggcagtaccataaatggaaaattcaaaaaaattaaacctaagaccataaaagaattattattaagactaccttcatcaaaaagtagtaaaaataaacttctaagcgcaaaaactttagcaattgtgaaaataattaaggggctagctatcaatgaaagcgaataaattttgaatatttttgatcttgaatttgcaacaaaaaaagcatagggaaatgctaaaattaaacaaataaaagccgaaattagaccaacaaaaattgaacggccaataatttgccaggtagttttttcctttattaataaatgattatcaaaactttgactattatgtacaagcggactaactgattttccaaaaagtaaaattaatggaattatcacaaaaatcagggcaaaaattacatagggaattacaagactgatgcgcggatttaaactttttttgaaattttttcaaaaattttcaaaaaaattaaatttcagcattttccatctccattaaatgaatagcatcatcatctcattttagaaaaacttgagtctcgaggtcataaaaatcgttagtttcgacattaattattgtattttctactttgatatcaagtgaatagtatgaacctttataaatattttggataacttttcctttaaaatagcctgaatttaggtcaatatcgatatcttctggacgaatcaggcaatctaatttttggcctgggataaactcatcatgaattgtatataatttaagaccaagaatttcgacctgattttttttaatgtattttgcctgaaaaaaattagaatcaccaataaaattagccacccatttattaactggatagtcataaatttgttttggttcatcgtattgggcgatttttccattacggattatggcgattttatctgataattgcaaggcttcatcttgatcatgagtaacaaaaataaaagttaggccaagtttttgttgaattttttttagaaaaacttgcattttttgcctaatttttgtatctaaagctgataaaggttcatcaagtaggacaatttcaggctcaattacaagcgatcttgcaagtgctacgcgttgtttcattcctcctgataattccgaaattgctcgattttcatttccagttagaccaacaaggtcaataatatcggtaatttctttattaatttcctgttttgtgatctttcgggttaggtatttttttttaaaactttctgatttggatgttagataattttctcaatttgaatatctaaaatcagaatcatctaatttatcctgtaattttttacgttttttaatatctaactgtggattttcaagcagtttttctaaatgagcctgtaaaatttttaactctttaatctttcgcttttgcttatcctgtcattttttctttaagtgctcaaattttttccagactacatccggaatttcttctgccttttttttaattctttttaatttaagaccaaattcaatatttccacgaactgataaatgtggaaaaagtgcataatcttgaaaaattgtagctgtatcacgtttatgtgccggaacgtcttttatatcgatgccattaaatttgatttcgccgcgagtagttcattcaaaaccaccaattaaacgtaaaattgttgtcttcccggaccctgagggccctaaaagtgtgacaaaatctcctcgtttaatgtccaaatttatttgatctaaaacttttttatcaccaaattctttatcaacatcaacaagggagataattatttcacttttttcaatatttttcattatttaaattttccccttaaattagataaaataaaaataacttctaatttgaataaaaaaatattttattcttaaaaaaaatatgaaaacttcatctttgaagaaaaaaatcttctctaatgaagaataatggggaatctgtcaaaaatattaagtgaagcggattcgaaataaaaagcagcatcatcaaaaagtgatgcttcaaatatataaagttttaataaatgtaagtactttttctcgaattccataggtagaataaaattatattatatttttaatattttttcttaatttaaaaaaatttatatttcaaacccttttggatgctaaggaaaaactaatttttatgatataattttaattttgatttgctttttttggtaaattaaaaatttagtgttatagctaaattagaagaaggagaaaaaatatgtatgataaatttaatagaaaatgtagttgtaaaagcagagcaaaataacaaaatcccaaaaaaacaaatagattattttattaaaactgctaccacattagagagttttctaaaagataaggaaataaaaaaatatattacaactgactactccactagttttatgcattcaagtagtccagaaaattttttgctaaaaaaccaaatgcccgttatggttgcgtttgctaatttcaatgttggacacaatattatcatataatatggttatgacccaaaaacagaaaaatatttagtaaattttggttgggagaattattctaatttagttatttcaaaatgagatatctgaagtttttgatcactagggtattggtgatcttttaaaattgatgatgatgatgatgatgactataagaaaaaacatcccccaaagcaaaaattactgagtaataacggtcaaattttttcctattcagaaatatttgaaaatgatcaggaaataaatagaaacggaaatattgtcagaaattacgatatttactaatttattaggaaataggaaaagcaaaaggaactttaatgcataaaagcaaaactggaaaaaaatcaagatataagaatttttttaactattcaaaaaataattttagaaaaaattgacttttaagtatctttttttctattttttcaattttttcaattttactttcattatttttatggcaattgaacaaaaaattcgacacacctatttataaatttccagaccaacaaattacaattgtcaaaaaaaatggccatgcttttaaaaattaagaaatcaaagaaattgaaaatttaaaatctgtgacttcagtttcaaaaggcgaatcaatattagaattcggcggattttctaattcggattcatttggttttagctcttcgcctacttgaattaaatcagttgatattaattctttttctaaaaataatatgaaaaattatgttaattttcaaggacgatttttagaaaaagacaacgaaataatagtttcacaagattttgcaaatttaaaagatgtaaaaattggtgacacaattgaatacaaatacaaaatacctgatgttttagctaatcaagacccaataattcatcgcgaaaaatttaaaatagttggaactgttggatatattaatactagttcagatttttatattttaatttcaaacaatggttataaaaacttagttaaaaatattttcaatttttcgaagaaatttttaattcaagacaaaacaggcaaaaataatgaaactgactttgctaaatttttgattcaaaatttatcactttatggaataaaaaaggaaatttcaaaaaacagtcaatttccaaaaattactgaatataaacagttcaattttataaaaaatttcagccttgataacaatgttaaaactcccatatctggaaaaattcctgcaaaaaataatgaaattcttgtaaatcaaaaattaattgatctttttaagcaaaaattaaatcttaatttaaatataggtgatgagataaattttacattgcaaaatcccaactttttattttttaaagaccagctctttatcttcaaaattagcggtatttttgattctgatgaagcaagtcagattctatttaataaaaacgtagttcaagtttttgataatgcactagatgataatcttcctttcaaactagacatttttcataattcaggcgaaaatccagtgcaaaatttactctcaaaattagaaaaaaagggatatgaagcgattaaaaaattagaatatgaagctcacgttggagtcgctgagatttggtcagtaattcttggcgttctaattatgattattcttctaatatcatccttttttgcttatggttttggtttaaaacaactcaaaataaataacctaataattgatggtttttctgcaaatgaaaataaaaaaatagtaataaaaaaaataaattcatactgattttttatcttaagtcttgtttttctaactagttttctcttgtttttcctttctagtcagttaccattttttaatcactatcttgaaaatagaccaaaaaattacataattggccgaattagtttagatcttttttgaatttcattagtttatcttatattttcaacaattatttttgaagctaccatttattttaaatactggaaaaattttgtgaaaatcaaaaatgtagcatcaacaaaaaggctttagaaaaaattgccttaaatttgtaaaatccttgctaatttaatcaaacaatttacaaaaagcctataaaaacatacacttttttactttttgattgattctaatttttgtaaaactgttgcaacatcaccgatttttccaataatcgtaatttcatcatttaactgaattattgtctcggctgctggcaagaaagtttctttatttcttttaattaaaaccacattaacattaaattgacgtaaattcgcatttctaatacttttgtttatataatgaggcgattttacattaacacttccggcaaaaactccatttgcaatttctttaagactatcggcatagttaagaaaatttttatccaccgtcaaaagcgccattttaattccagcttcttcttcagggctaataattcagtcaacgccaatctgttttaaaacccgcgcgtgccttttatttactgcccgggccgctatttttaaattattaaataaattaatttcggcctgtaattctaataaagttgcaataatttcaatattatctgaagtggctactataatcgtgtcaatatcttcaagcccaacctcatttcgcatcgcgttaatatcacttgcatccataataatgggttctatagtcgcaaattcacgaataaatttaagattttccgctttcttatcaatcacaatcacattatgacctgattcagcaagctgggaaattgccgctctccctagtcgccctgctccaattatacagatatttgctcgtttcatttgactaaattgtagaccaaaattgaaaaaatttttaaaattatccaaaaaaaataaatttaaaattttataaataaaattttttatctaactaaatcaaaaaaacacttttttttatagcattttttgattgatataaaaaaattatttttcttttagatttttgcttttgatttttataaaaactagtataattatatcactaactttgaaaaatgggcttattttagattttttagcttactgatatataaaaaacactagaaaacaaggaataatttatcaaaacggggaaaaatgaatttgaaaattaatttcaaaagttttctaaaatcactttttcggctaaaaaaaattcatataatttttgctgtttataccatagttatttttcttggtgctggctttttagttacgccttttgcacatacaaacgccgttgacaaaattagttttctcagcgcactttttacttcagtttctgcctttagcgataccggacttagtttggttgataccggaacaagttttaatgtttttggccagactataattgcaattctgatctcccttggcggaattggaatttttgcggtaaaattctatatttttaacttgatttttggaaaaaaaattagtattttatctcgtgaaattctcaaaattgaaagaggatcaagtaggttaaatgatctaaaaggtgtaattaaaatctcaattaacctctttttaattctagttttaatttcaagtttggcgctaatgcttcatttttattattatgaaattagcccaaaaaaattctctttccaacaaagtccatataaaaatttagttttatcactaagatttgcaatttttcatagtatttctgcaatcaataatgctggttttgatataattggcgcctatagtttcgagccttattattattcttattttttgcagattattattataattttaacaatcattggcgggattggttatcccgtaatttttgatttttatagttattttcggataaaactatcaaaacagaaagtgaaaaactttcgcttttcacttttctcaaaaatttcacttttaagttattttgtaatttcgttttttggttttattttatttattgcttttgaggcgagttcaaaatccaatcttactttttgaaatcaggtcgaaaatggtaactgatttgataagtcctttgcacttttatttcataattttatgtcgcgttcgactggttttttaacttttgatctaaaacaactttcacaagcaagcacgtttttaacaagtttattaatgtttatcggctctgcgccggcttcaacaggtggcggaattcgtgttacaactttttggatttttatccttgtaattatttcaagaattcgtggatcccaagatgttaatgcttttagaagaaaaattactacagataaagttgtttcagcctcaattgttttctttatttcacttgttttagtaatttttcttgtttttgttgctagtttttcccttgatgattcaattaatagaggcaaaactattccataccaaattcatcatttaatttttgaagttacttctgcttttggaacctcaggactatcaactggactaattcgcgacttgtcaactgtttctcaggtcggatttatgattataatgctgattggacagctcggaattacttcatttatttatgtttgacaaggcgataatatcggaaaacagaataaaacttatattacagaagatattttaattgggtaatttatatacttaaaatttaaaaaacactataaattacagtaagttagtatactgatttaacctaaacattgatttttatatatttttggctttcttattccggtaatttcaatttataatttaatacaatataaaaaaatatggccgttctaatctaaatttcagttttcaaagaaatttttaaaaaaaacctaggtttttttaaaaatttctcccgagtttcccagtttgatgagataattttaaaaaagtgtccggtttcccgtgcttttttaagttttttgccaaaagttaattacctatttttttactgatttattaagatatcaaagtagaaatcatacctatttcaaatattgggattgctaggaacaccatcgcgatttttaaatatcatttgttgatctaaagtgttaaattcaaccctttgtcttaatttttgcaacatcgttactaaaccaacttcagttaattgactgtttgcaaataacttgttatcactaatatgtttgttgattttaaaaattatagtttttaaaataactaatgagataaagcacaaaaatgtatgagctaggatatgctcatctattcttaaaaatacaggacgaatattcaataaaccttttagacttctaaaattagcttcaatatttcactgtttttggtatttttcaactatgtctaagacatttaaatttagtatatttgtttcatagacatagtaaccatcaaattgtttgtccttgtcaattttactttgatctaattcaaatttcatatttgaaatttccctaaaatatttaggttttttaccaaacaatttgtttacttcaataaaaccatctttattttgttttttaataaaactttggatttgctcttcgcgagccttgctgtcttttattgctctttttttactgtaagtaataactcttcttctaatattttcagtgtatcttttatttttataagatgaataaaattcttcttttttatacttaaaatctgcatttacatcaacataatcgctaggatctaataaataatctttaaatttttgactgcctatctttgcacgataagaaataatgaaattatattcttttgattcaagaaatcgaatatttgcagcagtggacatgccacggtcagcaattattgtcatatttttgatattatatttggattcaatatctaatacaaaagggattagcgtactagaatcggctgtatttcctttaaaaactttaatatgaaaaggaatgccatttttatcgcatgctaaagcaatgacaatttgatcttctttgaatttagcatctttagaatagccaggaattcttaatccatttctttcaaatgtctcaaaatagactgttgatgaatcaaaataaaattcattgtccctttttccaagctcgcttataaccattttgttaagactatctaaaagttgattttgtgattcatagacaagatctaagagtctataaaagctatttttggaagtatttatttgatttgagtaatcatcctttttatcaaaagcattaataatgctaccaggatcagtaattcgctttgaaattaagtagttaaaaatttgtttcatatttttatgcctacttttaggaagtgattcaaaaatattgtgcttttcaataagtttttcaattaattccccaccaataaaaaccgaaccttcgattatggcagaatttttaagagaatcaagtaaagttgtcttgattttatctttgtcatctaaatttgaaaataatttcaatttttctttgataatttgaatagcatttggattaattttttccaaagtttgcacatttcctatactaaatcaacgttttggagctttcccataaccttgtgttcagccaacatatttatatattttatcttttgaagatcctcaaacattaaacaaaatcaaattatgctttttcataatttataattataccataaaattactttaaaattgtaattaattgtaattaataaaaattaaggttttacgggtaaaaaacaccgatttacggcgatttctgcatattcatattcactaaaaagtgaattttcgccatcaaactgggaaactcaggaaaaaaatatggccgttctaatctaaatttcagttttcaaagaaatttttaaaaaaaacctaggtttttttaaaaatttctagattgtttattgcttaatgattatcagctttaattaaaatccttatttttattagcaattcctacaaaatgaattcgtgcaatcgaaatatatttgttccccatcttgttattaaagtaaattattatcttttttaatcgttttttaacatttactgtaactgaaagttggcccccgactccgataattttttccggttttgcaatattttcctttggtaattgatgaatttttccttccatatcctcatatgaaacactaatataatcgtgtcatcaattgtttttatgaaccggcgtatagtcaccattatcaaaaaagcgtaggcgaaacgtttcaacataataaccatgcggatattgtctaacattttgcggaatcattttaaattcactagctttatcactccagttattatctaaatatcagtaagtatttccttcgtcaaaaacgttttctggacgatatttatacccaaaataagttgaatattttgtatcaccaaaaccccaaatttgtcttggatttttcaaaatgttataatttacatagttaaaatgctctttttttagaaaacctgtgaaagtatttcccaaataattaagctcatatctaggttctaaataagtcgttaatttttcatcctttacgatttttaggtcactaaaaagtgttgaatttgtttttgttagtgctaattgaatttcgctttcggaaatttcctgcggaaattttcacaaattttgttttgcaaattcagctcattttttgtccatttcagttctaatatcatcaaaacttgttaattttattgttgtagctgaatttttgatctccaaaatttccttttttggattttgttttcaagtaaatgattttattatataatttccagtcttaattttttcaatttcagattttagaaaattaaaactgaatttaaagtgaaaattcgattttttatgagcagaatttgttgctgaattacttagtttttcaatttgtgctttgtaaaatttaagaaaataatcctgtttttcttggttttttagttccaaattaaaaaataaattactctgacttaaatcaaaatttgaataaacttccaaattaagaagtttatttttttcatctaattttaggccattcaccaaattaagttcgctttgaaaactgaatttttctgaattttctttattatagtaattaattttttgttcatttccaaattcaatagtttcaatttggtacttttcgtttatagttaaatcttgaaattttagctttaggtattgcaaattagtcttgtttttattggatatttgattattttgactagagttttcaacagttgcttcgacttcaaaagtctcatttttactatttttataaataatttttgccttgtcgttttccttaatttttcccagattgtcattaaaaggaattattgcatcaattgaatttggatgctggcttgaaaaaacaggaattgaatccttgaaaatttcatttacaataattttactactttgcgacttatcgaccgtaattcttgtattatcagaattttttaccgccactaattcataaaaagtattagtcttttcaagatttattattgttttgttatcgtttttcccattcttttcaaaaaattctgactctaattctttgtttgtggagttccctatttcacggaaaactaattttgcttgtttggcactaaatttatttccctcagtaaattgaatttttagagttcgttttttatcaaaaggtgatgagctttcatcagaaatcgtcaatccgactgtgtttttaatagttataaactcaaatttttctgcattttgaccatttgcatcataaaaagcgccttgttgattgtttaaattataattttttcaagctttttctggtttattattgaaaaataactgttgaattttgtattttgtttcacttttaagtcctataaaattaaaatttagcacccatttttcattagtttttttaattctaccttgaaatttgcctgttttttcacctttttctgttgttaaaaccgcgctgattatttgattttcaccaaaaacattatctaaactttttaattcgacactaaaatttgccgaattaattgttaaatcagtaaattttgcactatctttgacaacttcaattccttttggttcaattttaatctcgaatttattaactgcaactcatttttcgtctgtttcaattttttcaaaagtaaaaattctattagaatcaattttttcgaaaacaaattcagcatcttcgccttgaattttgtttgaaatagatcggaaaatttcattattactttttaggactaaaactaattttttaccattattattaagtatttttgcactaacaactaatttatctgtagaaaattccttaaacttgagttcctttaatgttaaaatcgcggtatcaaagacaaaattattgctaaaatcaattggaactaccttgttattttggcgaaaattaactttattaattaaatattttttgttattttcaagatttatgttgtcaaaaactagttttgagttaaaatttttaaaattagttgccactgtcttattagttttggcatctttttcgttaaaattcacattaacttgaatgcgatcgagattaatttgatcagaagttaggtccatttttaatgaatcaaaatttgtttgctcaatttgtttaagttcaattttattttctagtgaaaaaagatttgtttttgcaatgtttttgtgaaattctgatccattttctttttcaagccataattttttttgaattttaaaaggttctaactttttaatctcaatttgtttattaggtaaaacattaaaatgaaattttagaaaaagtttgtcagcttcttctaaaatttcaccgatagattcaatatttttttcgccttcacttgcaaaaattttaactatatcaccttgttttaatgttttattttcatcttctaattccaaatttgcccaaatttggtcaataaaatcactttttagttgtttgatttcttttaattttattggttcaaaatattttacaaatgaaaaatcttcaatattgttttgaatcttaatatcgtttagtttattttttgaatcataataatgaatatttgacaaataatattttttattcgttaaaattttgtcaaaagaaaagtggtataatttcttatcaaaatcaaaatatccatattttgaggttaatttagtttgtccatcttctgaatttatcgtcaaaaccaaatttgaagatgttaattcaggatcaataaaattaaaataaacatcaacagcgtcttcattttgcgctactttttgaattattgaaaattttttctcctgaattgtttcattttttgaagattctgtattttttggtagtaaaatttttgcctgttctgaatttttagcaaggtttttgagtggttttttaacatcaaattcaacaaaaagatcgtttaaattgattggttgattcatttttgttttctcatcaaaaaaataaatgccgcgaagagccaatttttgatctaaatttagtagactagaggttagttttgaacttgcaccggttgaatcaacattgacatttttttcaattttatatccttcctcattttttaaaattaaaaaaacatctcgatttgcggtaagatttttgttaaattgtaatttttcagttacggtatttcaaaaaacaggtttaaaaattggcgcattttcataggtagctttaaaaatttggtatccttgaatttcgattgaagttaatttgaaggaatcatcaagatttaaagggtgatttattgttaaattaccgagtttgtcaacttcaaaagaaacaaactcggaatcaaaatttttattttggaatttagaccttacaattttacctgcaaattctttactcaagacaaaatttactaaaatatcaccatttttattatatttatattcataattataaattctttcataatttaaacttcttgtactcaaaattataatgcccgaaaaagatgaaaccacaatcccagcgattccaaagattaaaaacaagttttttttgacaattttcattatttttctcactttttttctttttttccatcacagaaatttaatttttgttttttttaaaataaaaagaaaatgatctattttgtagatttaaaatcaaaatagatcatttaaaattttattggataagctcaggaaattcaattttaaaaactagataattttatcacaaaaaaatataaaagtaataaaaaaatttcaaaataccttatttttaaacattttaactctaaatttaagaaactaaaataaaattttaacacattgaattttgcttaaagaagctagttaaaacaaaaaagcattaaaaatatgcttttttttaattatttataattcaatctaaaattttttgctttgataaatcagaatcattcagaatttcttcaactttttctacatcaataaaggcaaggccgattttttgaatataatcaatttgttcagaatctttaaccgcaagcccaataacaaatttaacaggttggccgtctcaattaagtgtgtttttgaggtggacaatttcgatgcaatttctaaaaattagattatttccttcaaaatttccgtgcggtaaggctaaaaaatttcctaaagctactgaagattccaggtctcgtttttccattgactgcaaatattcaaattcacaacagtttttttgttggaaaattctaattaatttttcaaaagcttgcttttttgaggtaataatttgatttaaatgaatattttcgagttttaaattcattttttcagccttttcttttgatttttataaaaatttagcactaatttaatttcatttatatctaaatttgtttgattttttaggaaaaattcgggactttctgccaattttttctgcatttcgagcgcctgattgtcattttctcagtcaaaatttaatatataagcaaaagtttcataaataatacttaacttttcagatgatattttcgatttttttgcatattttaataacaaatcaaatctttcgttttttgaaatttttgtaataggatttcttgcaactcgcacaactaaatcttgcaaaacgggatttttgaacctttttattgtggtttcaaaatattcattcattattttttgttctattaagggatttataatcaaaactgtctgttgtaaaacttccttcattttttcaatataattttgaattatgacggaatttagcgcctcattaataaaattaaactttaaattataagcaaaataggcaattcctgagtgtaaggcattgacaaaaaacaactttctaagaataaaaaaatcgagattttccaaatattcaacagtttttagcttaattttttgttgcttttcctctaaaataatttctgaaaatgtttctgtataaacgtttaaatcatttgaacttggcgcgatttggtcaattgttgtatcaacaaagtttcaaaattggcacttttccaaaatagtcttaaaataagaacttactctataaccattttcaaagcaaataatttgcttatgtttttcttcaatttttgctaattttgcaaaaattgatttaagaaaaaccaagttttttgcgccgattgaggttgaaataatatcagctgaacttaatttttttaataaattttccttgttatttaaatggattgcttgaaaattagttattttatatttttcaccattttcaaaattaatgacataataaaaaccgttcttattcaaatcattaaccaaattttgattaacatcgacaaaaataatttcaaattgattttgatggtatagttttgcaatcaacccgcgcccgatatttccggcgccaaaatgaaccactttcattacaaaaatccttctttttcttgtatttttttaattttttttgctaaattttcataagattttttatctaaaaattgagttaaagtaataatttttgctgttgaatttttcgctttaacacgatcctcaagactttgaattgtgatgataatttcttcagcccctgttaaatctgcaattgctaaattagtaatttcaacatttctaattccattttcctttaaaatttttcgaaaaattgaggccgccatcactgaagaacccattcctgcatcgcaagcaaaaacaatttgttttcaatttagattattttcagttggtttttttagttttattttttcactttctactaattttttggcactttctaaggcaaaagtttctttttttgttttttttctattaatcaacttagccaaaaaattaactcctcaagcggcaactaaagtcgctaccgcagagccaaaaattccaattgtaagcccaactagtgaatttgttgatttttcaacttgaagatattgagcaataattgaacctggcgaaacaggagcaactgcaccaacattaaaaatttggaaaattgcattcgcaaaaaccccgcctgcaattaaggccaaaatcaaaattggccttaaaagtgcaaaagggaaataaacttcgtgaattccgcctaaaaaatgaataggaattgacgaggttgcttgacctttaataattttctcttttgaaaaaattaaataaaacagcaaaagtcctaaccccggtccgggatttgattctaataaaaacaaaattgacttgccggtttcagtgacttgaattgcacccaaagttgtaaaaacgccgtgatttatagcattatttaaaaagagtatttttgcgggttcgacaattaaagcaattagtgggtataattttcactgtcccatttttgctgttagaatcccgagtgattttataaaatatccaataaaataaattgataaataataaactggaagaagcagaacaaagccgagaatgccaaggtaaaaattattcaccaacatttgatagccacttggaattttatgaatccaaaatttttcgctatgttttaaaataagtgcagaaactgggccaaaaagcataactgaaactagcatcggtgcggttccgccagtgatttgggaaaaagtctctgattggccagcggcgactgatgcaattgcaacaataccagcaattgctccgccccgcattttataaattttatatcctcctaaaaaacaaattaaaattggaataatatagacaatcccgattttgaccattgttgctagttctttatttggggttcagcctgttgggataaaaaaggatgtcaacaaacctcaggctataaaaatcccaataattggcataatcatttggcctaaaagtgagccgaatgcctgaattttagttttaagcattttgaacaaattagccataaaactcctttttcttggtataatttttaaaaatgaatagtaatttaattgatcaactttcattgttattaaagcaaaatcggaattttattgataaggaaattgccagttttttgcttttaaatattcaaaaaataatgtctttaaagttggaaataattgccaaaagtgcaaattgttcaactgcttcagttataaaattttgtaaaaaactaggttttaaagggctaaaagatttattgcccgctttagatcgcaattattcgtatttaaatttccaaaaaaaacgttattctgagaacaaaattagtcaaaaaaatcaaattttaagcaaatatcatctgttgataatgaataatcttgataaaatttataatctaaactataattcgatgataaaatttgtaaaattattacaaaaaactcgacatataatgctttttgggaaaggctcaaatttagaatctatcaatatttttgcaaattatttatcaaaattgcaatatcatatcgattatcattatgattttgaggttcaacaaaaatggactgaaaaatcaattgactcaagtgtttgtgttttttttagtttctccgggatgcattcaataattgatgaattagttaataaaatgaaagcaaaaaattgtataattgtcgcttttactggaaattttgaaagtaatttatataagcaatctttaattagttttttaacttttaaaaatgaagatgttcttgaaaatcacacctctgcacgtatttcttttatatatttagtaatgcaaattattaatttgttgaaaaattagtcggtatttttatataccacaatcaattttaagtttttaaaacgataatttatatttttaaaattaattttacaaaaagaaataaaaattacttttttattttaaattttttaaaaaataaaaaaagactaattcactttaacattttatgttaatttgaattagtctttaaattaaagaaaattttctaatttttaaaaccaaaaaaagcaatttaaaaattatactttaatttatagtattttttatttttggagtattaaaattttaaaaatataaatagataaattttttatagtaaatttgaaaaaatcattcttaagcgggtttagctcgatttttaaagtgttttttaataattccatcaattatgaaaacaaaatatacaaaaaggctcaaacctaaaattatatatttcccagcttttggaatcagaccaagaatcccgggaatataaccaataaaatagtcagtatctcctcaatttagcgtaattagtgattgtttattagtcccttttattaaatttccaagttcatttgtagctaatggcactcaatttccaaggccaaaaaatacaggaataaaagtgataattaacccactaacaaaagaaccaataactgctcctcatattccgcctttgatatttccaaaaactccagaagttgcccctagaaaaaaatgaggtacaagtcctggtagaattattgccggaataagtgctgaatatccaagtccaagggtaataaaaaatccaataattccggcaaaaaaagaagaaataaagccaataattatcgcatttggggcataggggaaaaccactggacaatcaacagcaacttttgcatttttaattaatttatcagaaaatcctttaaacattggcactaattcaccaataaaaagtctaactccaaaaaggataatttcaactccggccgtaaaggtaaaagccgaaattatcattgtaaccacccaatttttttgtgctaaaatactaattacacctgcatcggcagctttgtcaaattttcctaactcatataaaatacctgcaggtaaaaaagcaaaaatataaaataagaaaactgtcagtgaaattgaaactaaagtatttcgaaaaaaatacagtgactggggaaatttaatttcttcggttgaaagtggcttttttttggcaatttttgcaattccttgaccaattagtcctgaaagggcataaccaaatccgccagtatgacctagggcaatttcatttgtgccggtaatttggaacatatatttttgctgaactgacggtgaaactaccatataaatcgccaaaatacttgatccagcaatcaatgccattgcaaaatcactcgaattattttgaaaatcataacccgaagtatacataacaacggctaacatcagtgacgaataatataaaacatgtccagaaagatagacatattttagtcgtgaaaaggttgcaagaataatatttaaaatcattgcaatcaccataattagcgagcctaaagtagcaatacttggcagactttcagtgagagcgccagcaaaagcatcattatttggaatcaccccgtttaaattataaaccctttgaaaaagcggttggaaaaaattaagtgaggaaactaaaactccagcaccaccacctaagacaagaaaaccaacactaactttaaaggaacttataatgatttgtgaaaaacttttacgcattgcaactgcgccgattagactaaaaagtccaactaaaagcgccggtgtgcccacaaaatcttttaaaaaatttaaaagtcagaggccaaaattcataaattatcctttcttttagcttatttttaaagttttttttaattttatctcgagttcttcttttgataaaatattagtcaaaattaccattttacttttatcaaaatcaagacttggggcaacatcagcgccgattataactaaatcaacatcaaaagaatcaaaactggaaatgttagtatgctcaactgagtcataatttatctttaatttttcaaggacagatttaacatttagctctaaaagtagtgaagatcctagtcctgaaccacaaacacatttaattttcattttttaaacctttgtattttttaataatttgataaaattctttaattgttctagaagcataaatttcttttttgaaatctgaattaccaaaaaaaagcccaaattcttgaattaaagcaatatgatcattagaatttggcgcacttaaagtaataataatttttgcttttttatttttttggttattaaaagtgatcatttcatctaaaactaaaattgaagttccaacttctagacaataatcgccaactggggcatgcaaaagtgcgacaccttcttcaagtacataataggcgccgtattttgctgtttgttccatgattgctttttcaagatcgtaagttgcttttttattttcaactaagatccttacgccctcatgaactgcttggtttcagtttttaattttacaaaatttagtcattttttcattaaaaagttccattatttcctcctatattaataaaagcgagtgtcataaacaatataaatgcaagcaaaagaacgccaataaaagcaaaaaagacgattcagccagcttttgttgatgtttttgtttgaatttcttttggttttggcattgatttgatataaaaaaatttatttggattgttctttaaaataattgcttcatttttagacttttgaagtaatttttctagttcaatttcacttttgttttcaagctcgctaatttcaaaatcatataattcaacaagttgtttttttaattctttttttcgcatttatttccccaaagcattaaatttgttgataaaattttgtaataaaaacggataaaacaaaaaatacttctttaaaaatgcgagttttttatatttaaaatatgaattagccactttaaattcgtccttttctaattttgttagcaaaatttgctttgattgtttatatgattgtgaataaattttttgatttagaaaaaaatccagaaataccacaaaaacagttaaaatcaaaaaacacaaactaactattaaatagcttaaaaatgaaaataaaaaacccaaatgaaaacttataagaaaactggaaaaaataaaaatatcaatttgcaatgattttttgctttttaggagataaaaattataaaagtaaagcaaatttactacaccataaatatggttttctaaataaaaattaggaattttaattattttttcactgattcaaataggttttaagaaaaaatctttaattaataaaattatgaatttttgttgatatttattaataaaaccttgttttatcgtttcaagatcaagtttaattgaaatttttagtttagagtatttaatttttagattaactctgtagataaaaaaaataaaaagttgaacaaggacaaaaataattcaagcagctaaaatgtaccaagacaaatttttaagcatttttctccttattaaactggttaattgagctaaaataatcaattatttttttgggaatgtaaattttttgactattttgtcttagtttttttataatatcgttttggcttcaaatttcaaatctagttttgttgtcaatttgattaaaatcaatccgatcatcaactaaaatgacaatttttgaattagaaaatttcttatctaataatttaaaaagtgagtcaaattggcttttagaaaagtaattttgctttaaaatcttaccttttttcaaaaaaataatgttttcatcaattattattttatcaatacccacttgataattgataatattagaaacaaaaaaaaggtttgactcattgacaataagaccaggtaaaactgaataatttagttttgaaaaacgattttttaagagcaaatttgtcataacttttacatcagcagaggcatttataatttcaagagcatcaattgtgaattgttctaccgaaattagtttatattgagatattttttctggggttttttcaaataatcttttgaaaatgaaaaaaatcaaaataagaaacagcaacccaaccgttgaatacaaaacaatattaattaagggcatttttttgatttcctcaaagtctagagaattcagaaaaatttggatatgaaaaaattatgctaccaccaattacaacatcaacgtttcatttttcaaactcaattcaattttccttgcgcaatccaccgtcggtataaattttaatttttttatttatcgaacgaatttcgccaatttttaaaaaaagttgctgatttaagggctcaccgactccgccaattttatctattgtcattaataaaatgacgtttgaacaagaaattatttcgcaaaagtcttcaattttttgattggcttgaatcattaaaccaaaatttatattagaataagacttatttaatcttttaaaatcagtttttgaaacttgttcggcgggtaaaaaaattgttttaaaacctatttgaattaatttttcaactttttcaagtgaatttttacacatcaaatgagcatcgaattcaatattagggaataactttattaaataatttgcaatttggtagtttagtccaaaatttggggcataaatttgatcaacaaaatcaatatgggcgtattttaagccgttattatgcaattttgttaaaattttaattactttaaaaatgttaagtgcgctaatgctttgtgagtattccaacactaaaccccattcacgatttttgtagttaattaaattctacttttttttttttttttgcaagcatctttaaaatttttttcattccaaccgaaaaaaattaaaaaatcatttgttttctataaaaaacagggagcaatgtttaaattagtatattaatttttggcactatcaaaaaaggtgtgacaaaatgaaataatgcaaatctacagctgaagatgaatctaaatacatcaaaattgcaaatctaaagggtaaaaatcgcaattttacattttacagaagaatttagccaaatttataaaaaagaaaaatgcaaaatagacacaaagagtcaattttggatgtatatgaaacaatttaataagaaattgacatataattaaaaaaacaattagaaattattttccctaatcggttaaataatgtaaaattaaattagatttctatttgaaaaatccctaaaaaatttaaaacacaaaattatgaacactcactttttttagttttaaaattttaacatatattaaaaactttttagggaaaatacctaaaaatattatattttaaaagaataagttattatgttaatcaattgcaaaaaataaattacactaaaattcaggcacatttttgcaaataaacataatttcaactatcaaaattactatttttaaatagataataaaaatgaaaaacaagttaagaattttaaaaataaacttaaatcttttgtctttaaatttattaattaataaaaagatctacgattccccttctatctcaagatattttttatttttatgaccgcgaaaatctactctcgcaatttcttcataatattgatctctgccatccaaatccctagaaaagggagggtgttcttctagaattaattctttttcttgttggctatataaattagtattttctagaaagtctgtaaaacgatcaaattcatggtctatttcttttagatatttattcaatgcatcccgatataaaattaattcttccctcgatgattcaatcacatttttagataaattgttataccttggtgatctagaaacaaaaaattcgggatctatgccatcacgcagaaaaatatcttgttcaagtttgaccaatttttgtttaaaataatattttaaaatttcgtatttaccttgataaatattatcatataaatttgaatgaccaaatcagtaataaattttttgattatcaacatacaataaaatgaaattttttaatgcaattggcaaaattcatccttcgcctgatccataggcggggtagtaatatggtttaaatcaaaaaactggcttttttgagtcaaattgggaaattatttcatcaaaaagtccgtattcttgcccaccaaagtaaaaaatttcgaaattttcaagttttaatttcgcccatcttggtagaattaaataatcaggtttatcggggtaaaaatattgaccttcaatttcatattttgggccaaataaaatttgcaacaaatagattaattcaattttatttgtccaattattcacactatcataataagtttggccttttttaccaaaaagttcgatgcaatattttcgatattctgggccaaatttatcaaatcaactaagaataaatttatcacgattttcaatatttaagttaagctttttaatcccgtatttttcaaattttttaagcaaattttcataagtttcaaaagtaaatacattttgaattggttgaatttgggttttttcactaaaattataattctcttttaataacaaattgtaaatattttctacattttgtcctaaatatgctttatttatatctacaaactttgaattatattcatatctatttgataaaaaatcaaagattttttcgtgataatttgctaaattttttggttttgcataaggaacactttcctgtatttccttaataattaaagcttcaatttctcttaattcgctttttgatttaaacatttttgaaaagacagccggataagagattgaaaattcgcatttttcaatatcatcaaagttttcaaagacaacagcaacaacttcttcaaaacctttaccgtcgtataaatcataggaaggacgaagttcatcgataaaatcaaaattttcttttccatttttttcacaatattcaacgtttgctcaaccgccaattaaacacctaatatcattataaaaatggaaattattgagtcttttggagaaaaatgcactttttgtgatatcttctagttttaaattataaatataatcttcttgtttataatttaaactaataattctttcaattgggttaggatagaagccattactaaggtaatataataaaaaattttcataataatactcataattacaattaaacaataactgaacttcatgctcaactatgtttcgaattgaacaacgacttttaatattaatttctatatattttagtttttttaactgtttttttgccttagataatgaatttatcagcttctccatataaaaaatgcaccttttcaatatttaacattttttttctttttataaattcgcgctttatgccccttttttcattccctatcattcttaatcttcttacatgataactgggaaaatatattttgacgtatgattgattattttgagctttacttggttgaatatcaaactcatttttagggttagttcaatcaatagcatcattagctagcccttccccaacaacaaagcgatctttagtaaaaccgatatctttatttaaattattatttggatctgttagccttccatttcctagaatcaaatttgctgtatcttttgttttttcagccaaagttctcataactaattcgttatgtgaataaaaatcaataggagaatttaatttttccctgatataatcacggtcatcttgattcattttatcttttattaaactaggcagcaaattatcaataacaatttgagttaatactgattgggctagcaaactcccaacggctaaaattcaggcttgagttgctgatatttcttcctgactaataacaaaataaggttttaagttttcagtctgaaaattaaaaaatcaagcaagatggattcccgtgtatttttctaatttttttttatcttttacaatagaaagttttaaagtagttgcctttgcttttgttttaatgctagactcacctttttcttttggcaatttttctaagtcaaccacaattgagctttcagttcttgaaataatcgggctataatcaactggcgaatactcacttctgccgttatcaattcatctacgtaggctatcaacaacttttggaacagtttttacagctgctacagtagctgttgttgctgctactgcagcaatggcagctgcaacagcttttgtaataaatggaataaaaggaagaaggaaaaagaaggttttttcaacccgagtttgattttgaagttctctaaagtcaaaaacgtgcccttcaaatcttagttttggtatacctttttcaaaatagagttcagcttttttgttaacaaattcaagtgaagcactatttaaaattacctgaccatcttgattaatttgaattttaatatcatctagattaggagtctctgaatgggtgcttgttttgtttagatgtgtttgggtttttttaatatttgcgttgataacaagcgaattttgttggtttttggcggaaacaatttggactaaatcatcaaaatttagcggtttttttgaatttaataaatctatatcacgggtttcgagtttaaaatctgaatagctttttgtattttgaaaatgtcaaagaggaccaaaaacacttagtgtcagtgaaaagaaaccgacaatattagtgataaacttaaaaagtttcagttttttcttcatgttttttccttatttatatattctttaatctttaagattattattgatttaaaattataacatatatttaagaatttttctgaaaatatcatttaaaaatattgtattttaaaagaataaattaatacaaattagtatgctaattttagacatcttcaaaaaagtgtgtcaaaataaacaatacagattcacagttgaagacaaatttaagtgtatcaaaattgccaaatctaaaggttaaaaattgcaattttacattttacagaagaatttagccaaatttataaaaaagaaaaatgcaaaatggacacaaagagttaattttggatgtatatgaaacaatttaataagaaattgaaatataattaaaaaacaattagaaattattttccctaatcggttaaataatgtaaaattaaattagatttctatttgaaaaatccataaaaatttaaaacacaaaattatgaacactcactttttttcctgagtttcccagtttgatggcaaaaattcactttttagtgaatatgaatatgcagaaatccccgtaaatcggtgttttttacccgtaaaaccttaatttttattaattacaattaattacaattttaaagtaattttatggtataattataaattatgaaaaagcataatttgattttgtttaatgtttgaggatcttcaaaagataaaatatataaatatgttggctgaacacaaggttatgggaaagctccaaaacgttgatttagtataggaaatgtgcaaactttggaaaaaattaatccaaatgctattcaaattatcaaagaaaaattgaaattgttttcaaatttagatgacaaagataaaatcaagactactttacttgattctattaaaaattccgccataatcgaaggttcggtttttattggtggggaattaattgaaaaacttattgaaaagcacaatatttttgaatcacttcctaaaagtagacataaaaatatgaaacaaatttttaactacttaatttcaaagcgaattactgatcctggtagcattattaatgcttttgataaaaaggatgattactcaaatcaaataaatacttccaaaaatagcttttatagactcttagatcttgtctatgaatcacaaaatcaacttttagatagtcttaacaaaatggttataagcgagcttggaaaaagggacaatgaattttattttgatgcatcaacagtctattttgagacatttgaaggaaatggattaagaattcctggctattctaaagatgctaaattcaaagaagatcaaattgtcattgctttagcatgcgataaaaatggcattccttttcatattaaagtttttaaaggaaatacagccgattctagtacgctaatcccttttgtattagatattgaatccaaatataatatcaaaaatatgacaataattgctgaccgtggcatgtccactgctgcaaatattcgatttcttgaatcaaaagaatataatttcattatttcttatcgtgcaaagataggcagtcaaaaatttaaaaattatttattagatcctagcgattatgttgatgtaaatgcagattttaagtataaaaaagaagaattttattcatcttataaaaataaaagatacactgaaaatattagaagaagaattattacttacagtaaaaaaagagcaataaaagacagcaaggctcgcgaagagcaaatccaaagttttattaaaaaacaaaataaagatggttttattgaagtaaacaaattgtttggtaaaaaacctaaatattttagggaaatttcaaacatgaaatttgaattagatcaaagtaaaattgacaaggacaaacaatttgatggttactatgtctatgaaacaaatatactaaatttaaatgtcttagacatagttgaaaaataccaaaaacagtgaaatattgaagctaattttagaagtctaaaaggtttattgaatattcgtcctgtatttttaagaatagatgagcatatcctagctcatacatttttgtgctttatctcattagttattttaaaaactataatttttaaaatcaacaaacatattagtgataacaagttatttgcaaacagtcaattaactgaagttggtttagtaacgatgttgcaaaaattaagacaaagggttgaatttaacactttagatcaacaaatgatatttaaaaatcgcgatggtgttcctagtgatcccaatatttgaaataggtatgatttctactttgatatcttaataaatcagtaaaaaaataggtaattaacttttggcaaaaaacttaaaaaagcacgggaaaccggacacttttttaaaattatctcatcaaactgggaaactcgggaataatgtaaaattaaattagatttctatttgaaaaatccctaaaaaatttaaaacacaaaattatgaacactcactttttttagttttaaaattttaacatatattaaaaactttttagggaaaatacctaaaaatattatattttaaaggaataagttattatgttaatcaattgcaaaaaataaattacactaaaattcaggcacatttttgcaaataaacataatttcaactatcaaaattactatttttaaattgataaaaatgaaaaacaagttaaaaattttaaaaataaacttaaatcttttgtctttaaatttattaattaataaaaagatctacgattccccttctatctcaagatattttttatttttatgaccgcgaaaatctactcttgcaatttcttcataatattgatctctgccatccaaatccctagaaaagggagggtgttcttctagaattaattctttttcttgttggctatataaattagtattttctagaaagtctgtaaaacgatcaaattcatggtctatttcttttagatatttattcaatgcatcccgatataaaattaattcttccctcgatgattcaatcacatttttagataaattgttataccttggtgatctagaaacaaaaaattcgggatctatgccatcacgcagaaaaatatcttgttcaagtttgaccaatttttgtttaaaataatattttaaaatttcgtatttaccttgataaatattatcatataaatttgaatgaccaaatcagtaataaattttttgattatcaacatacaataaaatgaaattttttaatgcaattggcaaaattcatccttcgcctccacaatcaacggagtagtaagatggtttaaatcaaaaaactggcttttttgaatcaaattgggaaattatttcatcaaaaagtccgtattcttgcccaccaaagtaaaaaatttcgaaattttcaagttttaatttcccccatcttggcagaattaaataatcaggtttattggggtaaaaatattgatcttcaatttcatattttgggccaaataaaatttgcaacaaatagattaattcaattttatttgttcaattattcaaattatcataataagtttggcctcttttaccaaaaagttcgatgcaatattttcgatattctgggccaaatttatcaaatcaactaagaataaatttatcacgattttcaatatttaagttaagctttttaatcccgtatttttcaaattttttaagcaaattttcataagtttcaaaagtaaatacattttgaattggttgaatttgggttttttcactaaaattataattctcttttaataacaaattgtaaatattttctacattttgccctaaatatggtttatttatatctacaaactttgaattatattcatatctatttgataaaaaatcaaagattttttcgtgataatttgctaaattttttggttttgcataaggaacactttcctgtatttccttaataattaaagcttcaatttctcttaattcgctttttgatttaaacatttttgaaaagacagccggataagagattgaaaattcgcatctttcaatatcatcaaagttttcaaagacaacagcaacaacttcttcaaaacttttaccgtcgtataaatcataggaaggacgaagttcatcgataaaatcaaaattttcttttccatttttttcacaatattcattgtttgctcaaccgccaattaaacacctaatatcattataaaaatggaaattattgagtcttttggagaaaaatgcactttttgtgatatcttctagttttaaattataaatataatcttcttgtttataatttaaactaataattctttcaattgggttaggatagaagccattactaaggtaatataataaaaaattttcataataatactcataatcacaattagacgataaatgaatttcatgctcaactatgtttcgaattgaacaacgacttttaatattaacttctatatattttagtttttttaactgtttttttgccttagataatgaatttatcagcttttccatataaaaaatgcaccttttcaatatttaacattttttttctttttataaattcgcgctttatgccccttttttcattccctatcattcttaatctccttacatgataactgggaaaatatattttgacgtatgattgattattttgagctttacttggttgaatatcaaactcatttttagggttagttcaatcaatagcatcattagctagcccttccccaacaacaaagcgatctttagtaaaaccgatatctttatttaaattattatttggatctgttagccttccatttcctagaatcaaatttgctgtatcctttgttttttcagccaaatctcacataactaatcgatcatttgaataaaaatcaataggggaatttaatttttccctgatataatcgcggtcatcttgattcatttcatcttttattcaactaggcagcaaattatcaataacaatttgagttaatactgattgggctagcaaactcccaacggctaaaattcaggcttgagttgctgatatttcttcctgactaataacaaaataaggttttaagttttcagtctgaaaattaaaaaatcaagcaagatggattcccgtgtatttttctaatttttctttatcttttacaatagaaagttttaaagtcgttgcctttgcttttgttttaatgctagactcgcctttttcttttggcaatttttctaagtcaaccacaattgagctttcagttcttgaaataatcgggctataatcaactggcgaatactcacttctgccgttatcaattcatctacgtaggctatcaacaacttttggaacagtttttacagctgctacagtagctgttgttgctgctactgcagcaatggcagctgcaacagcttttgtaataaatggaataaaaggaagaaggaaaaagaaggttttttcaacccgagtttgattttgaagttctctaaagtcaaaaacgtgaccttcaaattttagttttggtatacctttttcaaaatagagttcagcttttttgttaacaaattcaagtgaagcactatttaaaattacctgaccatcttgattaatttgaattttaatatcatctaaattaggagtctctgaatgagtgcttgttttgtttagatgtgtttgggtttttttaatatttgcgttgataacaagcgaattttgttggtttttggctgaaacaatttggactaaatcatcaaaatttagcggtttttttgaatttaataaatctatatcacgggtttcgagtttaaaatctgaatagctttttgtattttgaaaatgtcaaagagggccaaaaacacttagtgtcagtgaaaagaaaccgacaatattagtgataaacttaaaaagtttcagttttttcttcatgttttttccttatttatatattctttaatctttaaaattattattgatatataattataaatgtatttaagaatttttctgaaaatatcatttaaaaatattgtattttaaaaaaataaattaatacaaattagtatactaatttcagacatcttcaaaaaagtgtgtcaaaataaacaatacagattcacagttgaagacaaatttaagtacattaaaattgtcaaatctaaaggttaaaaatcgtaattttggattttacagaagaatttagccaaatttataaaaaagaaaaatgcaaaatagacacaaagagtcaattttggatgtatatgaaacaatttaataagaaattgaaatataattaaaaaacaattagaaattattttccctaatcggttaaataatgtaaaattaaattaaatttctatttgaaaaatccataaaaatttaaaacacaaaattatgaatactccttttttttagaattgaaccttttaactttttgcacattttaattattaactttaattataatagttttaatattctgtgacataatcagagctttttaaatacttttaggttataatataccttaaatttgttatttataagacacctttaaataaaaatgaaaaaatttactaaaaaatacggctttattggtttatttttggctctaaatcttggaattttgttggcaaacgttgctttgctaacaaataattgaataaaactgaatccaaaagttaatcttgaaagtcttttaaagtcaattgttgaaattaagattcaaaaaaatgaggaaatttcttttgctaccggttttgttatagataataaaattattactaataaacacattcttgaaaatagcgatgaaattgatattttttatcggcttgcaaatgaaaaagactataaaaaaaccagaattataaaaatttcacaaaactatgacatattaagtttgcaattaaacacacaagttaaaaatcttgaaatagaagaaaattttaattatgccgatgaaatttttacaattggaaacccacataatcttggcttgacaatcagcaaaggcattatttcaggaactaataaattagcaaatcaaagttttgttcgaactagtatcacaattgagccaggaaatagtggcggacctgttttaaatactaaaaacaaagtaattgggataatgacttttcgccttataaatgaaaaaccagttcaaggtatttctttttttctcccttcaagtcaaataaaagagtttttaaattcaaattaaatttttaatattctaaattatttactatcaaaaaccattaaattaatatactccaaattattaaaatttgtgattaagttttactctagtaagaaattgtagtgcgcaaaaactattattaaatcctctttattttttaagatttgaaaaggtaatatttcgacaaagataataaaacgcctcgttaaggctcggatgggtataagccattttttgcaagtcaaaaattgttaatttttgtgaaagtgcaagggcaatttgattgactagaagcgaagcctcttcaaggaaaatgttacatccaagaatttcaaaagttttagaatggaagaataactcgataaaaccggcttcaatttcgccattagcgtgggcgcggggcaaattttttgcaaaaatttttgctttttgtactttttgtacttttaagagtgttttttttgtttatacttgcttttgacaaattaattttttttgggctagttgttttttctttatttttatttggatttagaaatgtttcaatatctaagtttaataattccataattcgtaattcatcaattgcatcaagtaaggcattatgtgtttctaaataattttcatctttggttaacattctgtatatatcttctgcctttcatcctctttttaaattgccgtttttacttgtttctgcatttaattgaatatatttgttaaattgtttgtttttagcgaatatagaaatatcgttatgcttgaatgacttgtgcaattcaggcaaatgtctaaaatcaaattttgtatatgaaaaccaatttttgacttcattagatttcaagaaataaattagttgaacaatcatttcttcgcgtgtttgaacaacattagcatcttgtttaaattcaagaggaaggggagctaaaatattacgggcatacattccacctactgttaaattgttttttattattcaatattctttatcaaatcattgaaaatcagtgctatcagcaattacgactccaacggaaaaaacttcactttgatagtttgtttctacatcaattacagcaatgtttttattcacgttagtaattttttgttttttaattgcttccatctgattcctcaaattcttttttacgtattaggtttataagctccttttgaaattgtttgtacgagtttttcgctaaattcttctcgatttttgatttgaatttcatgcatttcgttatttctaatattccacaatatacctttttccttttctaaggctagcatatatgaagcagtttgtaaaaaatgatcagttgttaaattactaacaaatttaagttcataaactatatcattcttgataacatcagcgattccctgaacttttattctaagattattatcactaaattccaaccaacattcttgttgaattatctcgtctttttcaagcacttttgataatcttttatgcatttgatcaacagcattatcatcaacaaaatcgggtgaaacttgtttaatgtatctttcttgttgtgtttccaaataaacaagaaagagtgttaaatcttttattgaatttctttcactaatataatcttcatagttctgttttagcttttttatttttgctggtcggtgtttataacgttgttcaaaaaaattgataaaaaacctaatttctttatctatatcccaatcatcgaaataagatgcttcaagatagatccctacacatggtgtaagatcaattaaatcatcgtgtgtttgtacttttatttcggttgtatcttcggttttaattttttttacttcaagcattttgaacatattctgaagatcaatatcatacttgtgatcaaacatatcagacattcaaaatgaatcactgtttaattttactaaatttttggattgtttgatgatttcttcatttaatagttccttttcgtcttttggatttgaaaagataattttttctttccctctacttgctgctacacaaaatatgttttttacaatttcataatttgctgtaattggacttaaacgcttttgtcaataatctatggtaaaaacaaaaataacgcaaataggtttttccaatccttttgagctatcatatgttgtaaaaatagccgaattttttttgggcgacaaatttgcgtctctatctcttatagaagcataaacggtttttttattaaaaatatcactatgattttcttcaagataatttaaaacttctgtcatttcatcattaactcagggtcctggccctaaacataagatatcagcaggtttttgtgtagccaaaaactccttaatttcttccagttccatatattggatttgacaatttttgttgactccattaattgttttaccccaaattcgacccaacatattagcgtgttcttttggcattctgaaggaaaatgttaagctaatttttttatatgatcctaaaaatttatcaataaaatcagtaacatttaattttgtattatcgtaaattttctgactaatatctccaactgcaacaatttgtatattaggattttcttgttttattttttccaataaccaagatatttcttcagtaatatcttgatattcatcaattagtagaacatcataagcgccaacagaaatgttatttcttaaaaatattctaattgagtctgcaggggaagaattaataccatttcttcgcaaaaatccatatgcaaatccgtgataattttgtaccataacatttttgtttttaatcttgtttttagcttcaacttttaatagtctgttgtaagttaagtacaaaattcttttatcaataggaaatttgtcgcagagaacctgaatcactgttgtttttccacttccaatacaagcatcaactaggatattttccccttttaatgctaaattaacaacattttgttgctcttctgtgagtttatctgcaataattttctgtttttgtttttcagtttttctagccataattccgttagttattaagtgtaattattaataatattaatttaaaatttaattttactttttttttttttttttttttgcaagtaattctataattttttttatttaatagaaaaaaatagaaaaaaatatagaattttcatatttttataaaaaattaataaacctaatttattgattttttaaaactaataaaaaaatatccttttattaatggatatttttttattagcaagcaaaacaagaaaaatttaaaaaataaatttttaaatcctctttattttttaagatttgaaaaggtaatatttcgacaaagataataaaatgcctcgctaaggctcggatgggtataagccattttttgcaagtcaaaaattgttaatttttgtgaaagtgcaagggcaatttgattgactagaagcgaagcctcttcaaggaaaatgttacatccaagaatttcaaaagttttagaatggaagaataactcaataaaaccggcctcaatttcgccattagcgtgggcacggggcaaattttttgcaaaaatttttgctttttgaaaatcaacatccaaatttaataattgtttttctgtcttccctacagaagcaatttccggaattgaataaattgcccaaggaatcaattctgcgctaaattcttcatcagaactaccgaataatatgtgctttgcaacaatatcagcatgtttgtaggcagttgatgaaagcatcatttgacccgtaatgtcaccgattgcataaatatttggaactgaagtttgcataaatttattgatttttagaaatccacggttatctagatcaatttttaaaccagagaatgcctcattttggggctgacgaccgattgccaaaagaatatttttggttgtatgagcaaaaattttgtcttctttttcaagtaaaagttgcccattttcatattttttgacttttgttttagtaaaaattttcactttgtttctgtctaaaacaaaatttgccgcctcggcaattgaattatcaaaattggcaaaaacacgatcatttccttcaattattgtaatttttgccccaaaactagcataaaaaactgcaaattcaagcgaaattgccccaccgccaatgattgttagttcatcaaattcaattttgcctttaaaaaaatcatcagaagtaattaaatttgctttttcagcaccttcaattttaatttttcttggtttagagcctgttgctataactaatttttcaaagaaaaattcttcattttctgctaaaactgtatgatttgatgtaacttttgcttttttattataaaaatcaacaccagaattttttaatgtttctaaaattgagccttgtaattttagtgaattattttttgctctttgaaaaatttgcttaaaattaaatttcgctactgaatttaatccaaatttttctgcattatcaaaataagatttaatttttgctgatttaagaattgtttttgtaggaacacatcctcaatttacacaagttcctccgagaaattcttgctcaaaaagcgcaacttttttaccatttttacccaaaatagcagctagagaatgacccccagggccaccaccaataataattacatcgtatttttgcattttttccagctttttctgtttttttttttttttttttttgacttttttatttttagtattactactaattataactaatttttgaattttattatataaaaaatacaaaattcaaaaattactaaaaaataactgaaaatatggtataattatagctacaaagttatagctaacctaaatatttaaaaatgatttataaaaatcttagaattgttagtcattctgatgaatttataggttgaattgaacttgataaaaacggaattattgttgatttaagtagaggaaatacagaatcttcaggaattgactgcaaaaaccacgttttattaccggcttttattgattcgcacacccacggcggctatggattttcatttgatgacttttcagatagttgctgggaacaaaattttttagattataaggaaaaactacataaatttgaaggtgtagcagcaatttttggaacaactattacccagcaatgggaaaaaattaaggaaaatagtgaattttttttatttttgcttaataaatatcctaattttttactaaattgatatttagaaggtccgtttatttctgagaaaaaaaaaggggcacacaatcaaaatttaataatcaaaccaaaaagagaacattttaagtttttggcagaaaagtttaacaaaaaaattacagtggtagttgcccctgaaaaaacttcagcaaaattaattgattctttttataaaacaattaattttgcgattgggcattcgaattcttttgatttcaaaaagaatcataatttaaaaaagtactataaatttacgcacttttttaatggatgttcaaattttgaccaccgaaaacaatcacttgtcaaccttatttttgaatcaaaattacctaaaaattttcttgttgagttaatcactgacaaccttcatattaaaaattcaaccctcaaatttacaattaaaaatattaaaaaagaaaattgggttgcagtctcagactcgcttgcccaaaaaggacttgataatggattttataaattaggagaactaaaaattgagaagaaaggtgatttattctatctaaaaaattcaaaacaaattgccggaagtgggatgtcatatttaaaaattcttaagaatttaaagttaaatttgaaactatcttgacaggaaatagttttttgttcctcttataatgtggcaaattcattgggaattctagatttttttgggtcaattaagataggacaaaaagcaaattttgtaattttagatgataaatttgaactaaaaatgtcaatcatttttggccaaatttaccgcgaatttgcaaaatagtctatgaatttaaagcttttttaaaccagagaagaaaaataaaatgttagattcttatgctattttaagataagaaagaattttttctgtcatcttttcaattcctttttcattaattttccgaatatcaaaggcatttggattttcctgaaaatatagtttcacctgttcggaaaaactaactaaaaggtctgtaaaaatattgattttgttaattccacaactaattcctttttgaatttcttgaatcgaaagaccacttgttccatgcataacaagcggaattctatatgcttttttgaaattttggattaattctcagttaagatttgcctttttcttgtaaattccatgagcagttccaaaagcaattgccaaaagatcaggttgagtttttttataaaaatcttttataatttctaggtcaagaatttgctgattttctgcttgatgaccaatttccttcccgccgatttggccaatttctaactcaaggaaaatatttttttccttggcaagttcctttgcttttaaagatttttcgatatttttagcaacatcaaattttgagccatcaaacatagcagaattaaaacctaattcaagatatttttcaaaaagttctaaatcatcacagtgatcaaggtgaaaaataaattttcctggtgaatttttaatcgccgaaacaatcattggtgctagaaattcaatacgggaatatctaattcctcccaaacttaactgaattattaagggttttttagaaatttcacctgctttaattacagcaaaaagtgtttctaaatttataacattaaaagcaaaaattggtttattctctgcatttagttttgaaaatgtttcttttggatcgataaaaaccattattttcctatcatttttttaagataatcagctacaaattcaacatcggttccaataataatttgatatcctttatttccaacacggacaactccacggccgccggcggctgtaatttttgcatctaattcatcattttttgcattatctttaagaattaatcttagccgtgttgcacaatttgagacttcttcaatattttccttacctaaaatttcaataaaatctgctgccattttttgatagtcatcagcaaattttactttatttttagttattttttcttgatcaggtagaaatatttcctgattttgcaagtcagttttttcatctattatactaaattctggcccaattttatcttcacgacccaaagttttaatattaaactttttaatacaaaagaagaaacttgaaccttgaattacaaacattatcgcggaaaaaacccaaattcatagtggatttgccaaaactccaaagttttttgcaaacgcccatgaccttggaaaagaaacaatataatcaataaatccagcagaaaatccaattccgatactcattccagttcaagatacaaacatgtaaatcactgaggtcaaaaaagcatttaaaagtcataaaagtggtgagatgaaaataaaagtaaaaattaaaggctcatcaattccagtaagaaaacttacaagtgtcgctcctgctaaaaaggtagtaattgtttttcttctttctttttttgcagcaaaaatcattgcaactgcagctccaggaagcccccctaaatataacgggaaaaatccggttgtaaacccaccagagccaataattccagtattaaatgcagttatatccccatttacagtataaatttcacctaattttgcaacagtttctcccacctgattaatcacgggggaaattaatttacccttaattggcaattgaaatcagacaaaagtattcaaaatatgatgaagtccaaaaggttgtaataatctatttaaaaatgcataaattgaaacataaaaccctcgagcataatgatttgcactttgatctgatagagctgaaccaattttaattagtccatattgggctcaaggtcaaataattgcaaatatcaaaccaagcggaattattgaaagaattcctaacataggcacaaatctgcggcctccaaaaaaagaaagtgtttgtggtagtttaatatttttgtatttattatacaaaaatgcaacaacaagtccaacactaattccgccaataactcctgaatcgagctgataaactggctttcctgcttttaaaaaatacaaaagttgcgtaaatcctttgagttgaccggacttagcaactaaaacatttttataaattgcctccgctaattggttctgttttagaagtgttgacatcccatatcaaacaacagcagctacaagagcggcctcgccacggttgtctttggcaaaaccaaaaccgattccaattgcaaaaattatcgctagattatcaaaaactattccgcctggggttgaaatcagccttccccaaaatttttgcgtctcggatattccaattgatccatttgctaaaggatcctgaattagtgcaccaattcgtaataaaagtgccgcaatcggtaaaacggcaattgggaacattagtgatctaccaagccgctgtaattgattcaaaattcggttaaaaatcgaattttgactataattttcggccttttttggccgaaaaaactttattttttttacaaatcctactgacattataactagtttttctaaattttttaataccaaattgcactttttaaagttttttctgataattttgatgctgcctttttatctaaaatgaaagtgcaatttggatgtaattgtaaaaaagaagcactaatttctgtattaggctcatcttctaacattgattttgtcacatcggccttatgagagccaaaagagatcataatagctttttttgtatattttaaaattgtttgaattcccattgtaattgcttgtttaggacattgatcaaaactggaaaatttaccttttctaaccatatcctcaattgtttcaggggttaaatttgtcacatgtgttttagaattaaatggagttttaggttcgttataggccatatgaccgttaattccaatgcttatatattgcaaatcaattggttttttcgctattttttcctcataaagtctagcttctttttcaggatttagagctttagaatctggaatatttatttgtgaagttggaatattgacaaagtcaaataaattggttttcatctgttttataaaagcttctgaatgatttttgtcaattccgacaaattcatcaaggttaaaagttgtaattttttcccaagaagtcccgttctctttgcgatcttttactaaaagtttataagtctcaactggcgagattccggttgcaaaacctaggactgaatctggctttgttctaatttggtcgataaaaagatttgcacaatatttgtgcaaatcgcttaatttttcaaaaattaatatcttcattttgtcctttttaatctaaaatagtaataattgaaattttatcacgcataaaataaaaaatagtaaaaaaagcgaaaaaatttttttatattgcaatttttaaatatttgtgatataaataatgaaacactataccggaagcattaaatttttcgctttttttctttttttaaatttaaaaatgagttataatataaaagcatttttaaattaacagcattaaatagttttagataaaattcaaaatttgttaagatttgcgagtagttagctgtaaatgaaagcattagattttgaatcaatttagaatctatttagttttctctttttagtctaaaaatgcgaatttaaaattaaaaggagaaaaatgtcacgttatactggctctatttttagaaaatcacggcgtcttggtttttctattcttgaaacaggaaaagaatttgctaaaggaaaacaaagacgatatgctcctggtcttcatggtctaagacgttcaaaaccttccgattatggggtccatcttcgcgaaaaacaaaaagtacgttttatgtatgggctcagcgaaaaacaatttcgcaatacttatcgaaaggcaactaaaaaaaccggaattgctggaacattgtttttacaagcgctcgaatcacgactagataattcagtttatcgtgctggttttgctgaaactcggcgtcaagcacgtcaacttgtaaatcacggtcattttttagtaaacaacaaaaaagtagacatcccttcatttcagttaaaacagggggatattttcgaacttacaacccggaaagacggaaaaattagaaaaaatcaacaaattttaacctctttggaaacaagaacgccagccgcatgacttgaagttgacaaagataatttcaaggttgtttttaaccgtatgccggaacgatcagaattaaaccaggaaattaaggaatccttaatcgttgagttctatagtaaataatcaattttttaattctaattagtatttttagaaaaaaatccagaaataatttttaaatgtttttggatttttttctaaatgtgatataatttaggtgaaattctaggagaaaaatgcctaaaaaatttgctattacttcagatcatgctggttttaaaagaaaagaagaaattattgagtatttaaaaaaccaaggttttgaagtaaatgatcttggcccaaaaaatgaggaatcagtttcatatgctgtttatggtaataaactagcaaattttttgctagaaaatcctgagcaaattgggattgctatttgtggaacaggattaggaatgtcttatgccttaaaccgatttaaaaaaattcgagctgcgcgagttacatgtgaaaatgatgcttatcttgcaaaattacataataatgcaaatgtgattgcactttctggccgttttaattcaaaagatgaatcaatttcttttattaaaaaatttttagaaaccgaatacgaaggtggccgtcatcaagaaagaattgatgaacttgataaataatgccagaattaccagaagttgtcacggttgtaaacgccttaaaaaccgaggtaattggtaaaaaaattaaaaatgttttggcccgtgatagtaattttatcaaggaaattaatttttttgattttcaaaaatccattgtaaatgcgactattattgacatccaaaatcgggctaaacatatattaatttttcttgacaaccgaaaagttatcttatcacatctaagaatgaatgggaaatattttacatataaatcgcctcaatgaggaaagtatgactatatttcctttgttttttctgataatagcgtcctaaattacaacgatagtcgtaagtttggaacttttatgattcgggatgtggaattattatttaaaactaaaccacttaaagatttggcgcctgaacctttttttattaaggttgatgatttttatcaaaaaatcagaaaatcaacacgctcgattaaggcaattttgcttgatcaaaaaattattagtggactagggaatatttatgctgatgaagtttgttttgcaacaaaaattttcccgggaaaaactgcaaaattgatttctcgaaaagaggcagaattaataatttactttagcaaaaaaattctacaacaatcaattaaacttggcggttcaagcatcagttcttatacatctttgaatgcaaaagagggaaaatttcaaaattttttaaaggttcatacaaaacaaaattttccttgctcaaattgccaaactaaaattttaaaaacagttattgctggtaggggaacatatttttgccctttttgtcaaaaattagacaatttttaagttaaaatactatttttgaagtgttttttagtaataaatttataatttttatggcttaaaagccagtgaaacgcgcaaaaaaccctataattaagtttttttagtttacattatttattataaaattttttatttcaaaaattagtaaaaacattaactaaataaacaaaatcattgaatttttcagtttccaaattaaaaaattcaatgattttttcaggagaaattcctaaattaatatataaacagacataatcaaaataaggattatttagtctaacccactcaaaatctagtagaaaaacgtgtttatctgaggtaataatatttttaaattgtaaatcgttatgagaaattacaagttgatcaaattggtatttctgcactaattttatatattttttatctattatttcactaacgtttcagtcaaatttagcaatcttctcatttttttgcatatgaaattccaagactgcaaaaaatagtttctgcagattagtttctaaatttttagggcttaaaatttcgccctctatccatttcttaataaaattacctttggtgtaaaagaaaaaattaggattatttctgatgaaattctcctcattttttcaatttacaaaattgttaatagcaattcgaatttgaactttatgattcttaaaaaaacctagaaaactgcagttatgatagccacaagaaatcagttggtaatttgtcaatttttgccttatattttttggaaaaacatcgaaatttatagttttttttcaattcattagtcattaaaaaataaaaaaaatttttaattctgactgttttggcctaattcaagatcaaaataaaccattgtatgatcggaaattcctttaattctgtttatttcccctaattgattaattttataattcattgagcgaccatcttttttccgaagctcatcatatttttctacattagcaatattttttttaaaaattgaaaaaatatcaaatttttgcccgttatttgcgacaagattgcctttataaaaaattttatcataggaatttgaatatttgccaaaagtatttgaaagtgaagttttttcttctttatcaagcaatgatctataggaatttagtgttgatttaaacaacttttcagaattttcggcacggatatttgtatcagccataaaaattatttctttgttttcgccgtcttttttatcaatttcaactaataaatttatcaaatcacgagcttctgcggcttcttgagaaccttgtgatgtttccttatcctgaatttccccacgatttttttgcactcctggagcatcaaaatgaccaattacaaaagtaaaatcctctttcctttctgttttagtattaaatttaacggctgcaagcggtctggctcattctaatttaacacctttttggatcaaataaggatttgatggactggcaaaattagctatttctaaaagtgaagacttatataaaaatgtatatttttccttctgatttaccttgccctcttcggcagtggttatttctttccaagcggcattaggatttagcgtatttaattccttaacaatatcagatccatcgccggtctgcgttatctccgctaagccaactagatccagctttgtagagtttattacctgcgaaattgcatatgtttttgctgtatttgtttttgaggatttatttgaataatttaaaacatttcaaaagccaattcgaatagaattttttttatgatctggaactaaattagtattttctaaattacttgttgaatttaatttttcagtttgattaagggcagctgttgttgaatttgatttatttgttgatgtttgataaattaaataagctccgagtccggtggctaaagaacctaaaaagatggaggaaaaaagaaataattttttaattttcatatttacattaatactatttttttaatatttactagctaattcagttagattttcgtatactttttttaattcaagttcgtttaaaattttcactaataatggactaattttgatgtctaatttctggaaaatatcaaaatcaaaattagccttatcatttaatttaataaaatttttaaaaaataataactgttttattttttgattaatttgatttgcgattttttgattaattttatcaagatttaataaaatattatctaaatttttgtatttttctagtaattttatcgctgtttttttgcctaggccctcaattaccttaatattatcagaaacatcccctgctaaaaccttaaaatcaatcacttgagagggcgaaaaaccgtatgattcataaaaattttcctgtgtattaatatttatgaaattatttttaatttttgtaataactttagtttttttatcaactaattgtagtaaatcttgatctgcactaaatatgagtatttctgcttcattatcttttttctgaatctttttttttagcgatgctattagatcatcggcttcaaaatcttgatgttctgatcataaaaagttcgctaaactaagtatttttttaatttgatccatttgaaaaaaaagtgaatcaggaggttttattcgcccttttttataatccggatacatttgatggcgcggggttttcgcgccaaaatcaaaagcaaaataaacattatcaggtctaagaagctttaataatttaaaaacagaactaaaaaaaatatgaactgcaaaggtcatttccccttttgaattaataaggcgattaccatgaaatccaccaaaaaatgatttaaaggttaatcatgttccatcaattaataatatttttctagccatagttagcaattttttggacttccttttaaatagaatttgcctggttttgaaaaaaacactataaattcatagtgtttttttgtctcaagcaataaataatctgggtttttagtaaagattttgatctcattttcatcatcggctaaaatcaccataaaatattcgctattagcttttcttaatcttattacattttttagctctaaaattagccgatattcattcccaattcttaagtcttttagtctgatttgattagtgaataagtaattattttggtcatcaacaaacgacattccaagatattttacctcattttcataatttttttcttgattataaggaattttttctaaaaattctaaatccaaaccaaaattatctgttgtaagaactaaatttccgtctttatcattaagcacaaaactagcatgattccaaagtagctcaaaattatgagctaatgtctcctgattgccaaaatcgctaagagtatttgcaaaaatcaatttttcaattgccacttttgaaaaattgactaatttcattcttttaatgaaatctaaaaaatttttatatatcccattttttgatctttcatcaataattgttttaatcgcaatcgttccaaggcctttaaccattaaaagtggaagaaaaattgtgtttttccctttatcaaaaacagcattttctgttgaaaaattaatatttggcctatgaattttaaaaccaaaatttctcgcttcaccaacatattttttaatttttgcctgcgcgccgttttcatttgaaatcaactcaacaaaaaaataagcaggatacttggcttttaaataagccattttataagctaaagttgcataagctaccgcatgcgccttgttaaatccatagtcagaaaatttataaattaaattataaatatcttcaaccaatttaggttcatatcctaaattagtcccgtttttaatgaaattttccttaattttatctagttttgtctcatcttttttcgaaattgcaacccggattatatctgcttgttcgaggttaaaaccagctacaacctgacagatctgcataatttgttcttgataaataattacaccaaaagttgattcgacaattttatcatattcaggaaatattttctctcaattatttctctccttattttttgcataagtaggaatttgctgaattgggccaggacgaaaaagcgaaattatcgcaattatgtcattaattgaactaaccccaatttttttaatgcttgcggtcattcccggtgattctaattgaaaaatcccacttgttttcccttgggatagtaaattatttgttgaattttcactaattggtagctgattaaaagtgattttatgcccatctgaattaattttcgctagaatattagctactattgttaaatttttcagccctaataaatcaatttttagaagggaaaaatcctcaataaattctgcagcatactgaatttgatttaaattttccttagaattatgaacaggcactaattttgtaattggaatttttgataagactattccggctgcatgagttgaggactgtcgcggcattccttctaaaaaagcgctgattttatagatctttttataaatttcgctattattttcggccttaaaattatcacctttttcaattaatcttcgaaattctgaggatttttggtcatataattgggataaatttgcattgttcggaattaattttgcatttttgtttatttggatttcgggaattccaaaggtttttgaaatatcacgaaaaacacttttagctgctaaagtggaaaaagtaataattgtcgcgcaatggtcaggcccgtatttttcaaataaataatcaataacctcttgacgtcttgtatcctgaatgtcaatatcgatatcgggcatcgtaatccgttgcggatttagaaatctttcaaaaattaagtcgtattttaaagggtttacagaagtaatttcaagtagataggcgactaaagaacccgaagcagacccacgacctggcccaatcaggatttcatttttcctggcccattttagaaaatctcaaattatcagaaaataattagtaaattttagtttgcaaattgtttcatattcatattgcaaacgcgctttccatttataatttgacagttcaattctgcggttttgaaccgcttccttaaggattttttttaataaaagatcggattcaagtccatttttgtggtctaagtcaggaagattaaaatcaattttgggaaattgaatttgaatattttcgacaagataattggttcttttaatgataataggatcaatttcttgttctcatttattaaagtcaaaaaatttggtacttgaatctaaagttgtacctttaatttttgaaagtgcttcaaggtaaattttctcctctgcaaaaagtaaatttcgctcttgaagataaacagcattttcaattttaggattgttttcaacaatataataatttttaagttgattttcgccaaaaagtttgcctaattgttcttttttttgagcataaaacccttttttggggtgatcaactataattatatcatctttttctgcaagatctgttaaaaaaaggtcttttttttttgttttttttgaggaaaattccgaaagaataacatatcctgaataatttttggctagcaaaataaaattgaaattttcaatttcaatttcaagtccaattaccggatttatcttgttttgcttacataatttataaaattttggtaccccaaacattgaatttaaatccgttattaccaaagtttttaaattattttcaagcgcaaattttatcaaagagtctaatttgatcgttgatgataaaaatgtgtattcagttcttgtatgtaaattaattaattgcatatctttggttaaatattaaaagtaaaaaaagcgttttttatgtgctttttttacttttctttttgaatttcactaaatattttatcaattttttctactctttctacaactggatctagtaaaaaatggagttgtggaactttaaaaccttcaaggagattgccaaatttaagcctaataaatttttccgctttgataattttagctaaattttttctttgactaaactgaaactctaaataaacaaaaagatgggaattatctgctgaaagtcgaactcaattaacagaaaccggcatcctttctagaaaatatgtctcgattacttttgaaataatttgaaagtaataattttgttttttctcgtgactaacagacattctcttcctttttattcctcaatttcaacatctaaaaatgcttttagctcatcacctatttcaatatcattaaatttatagatatgagttccaaactcgttgccgacctgaacttcttttaccggatttttatctctttgtagggattcaatttttcctgaatggatcagttttgaatttcttcaaagctcaattttacaattttcgacaaattttcccgaaagtacactacatcctgcaattgatccgacttttgaaaatcagaatttagcaataatttttgctgtcccgatctgctgaagttcatatctaatctcacgcattccacggacttgttttttaatttcatcaacaattttataaataattgtatgttcgcgaatttcgacttgggcttgttttgcttgggctttaattgcagctggaatttgtaaattaaaggcataaattattgaatttgaagtttgggcaagtaaaatatctgccttatttacaatgccgacaccagagtgcaaaatgtgaatatgcacttgttttgatgcaagtttttcaattgttgaatgcaaagcctgggcaattccggcaacatcggccttgataattatatttagtgttttctcttttgtttgctgttttgtttgcacttttgtctttgaaattttctctgactgttttctttcaagagctaattgttttgcaaatttttcttcgtgaaatccgaaaaatttatccccggcttccgggacataattaagcccagtgacaattaccggagttcccgggggagcaaatttgattggctgaccattggtattttccagtgaacgaatccgaccatattgataaccagcaacgataaaatctctgaccattaaagtcccattttgaaccattaaagttgcaattgtccctttattatggtgcaattttgcctcaataactgtcccgattggatagcgatttttatttgcttttaattctaaaatttctgcaagtagtaaaattgaactaaaaagggtatctattccttgacccgttagtgccgatccatagacaaaaatgttacttccacctcattcttcggtgacaatattaagcgcagatagttcatttttgatcctatcaacatccttgtttggcttatccattttattaacaaaaacgattattggcacatttgcggctgcagcatggttaattgcttcttttgtctgaggcatcactccatcatcagcagcaacaactaagacgataatatcggtcacttttgccccgcgggcgcgcatttgtgtaaatgcttcatgaccaggagtatcaataaaattaataatatgaccttgaaaaacaacttgataagcaccagtatgctgggtaattccacctttttcattttttgcaatattagttttccggatataatcaagtaaggttgtctttccatggtcaacatgacccataactgtgatgattggcggacgggggctaagatctttgtcctgatcaagaattgaaacttcctccataaaattagaggcatcaatttggacttcttttttaaaatcaagcccaaattcaaggcatatttcggcaatttcgtcttcagaaagactatgatttaaattatacatttttgcctgatggaaaaaataagtaataatttgattcactgagacattaattttttgagctaattcagcaattgtcattattcctgaaaaaaggaagacgccgttatgaactttagtttcaacagtttttaattgtgctttaatttcgcttacatttgagattcgtttttgactttttttcatagaatttctacctcatttgctaaatttgtataggcaagagtggaaatatttgtcttaaatgcacgattaaaaagttttttttgaattgcttgttgaattttatcataatcagcaaaaatatatgcgcctctgccaccaatttttttatcaaaaaatttatcaattactaactttttatcaatataaacaaatcttattaattcacttactggataaattttttgatcaacaatacattttcttgtataatttttcacttttttatcctagaaatcaaaatcatcaatgtcaatatcgtcaacccctgtatattttagaagatcatcatctaatttgaaattttttatttgtttttcattttggatatataaatctgaattttggttaggttcttgactagctttttggatttgagcttcattttttgctcatttttccttctcttgtaataataattcttgttttttttcctcttcttggtgaattttatcgattaactcgttttcactaattgcctcatttagagccgaatcaaaaagtgaatctgcatcaaaaaaagatctttgactaatattttggaaagaattagaatctttctcgttttcaaagccataatcaaaatcttttgaaatattttcgcggatattctggcttttgttaaaattacgcgatttagttgctgcttttgctagattattcttgttttttggaaattcttggtgacttcttacctgtttttgctcattttttggtataaactcgttttcaatcccataaggtttttctaactcgcgaatatcagattcgaattgctgtaaaattaagtcaaaattattattaccttgaccatatgaattccgatgattttgataaattctaccctgctggcgatgaatatactcatttttaagactgtttagttcttgaatgtctttaatatttccatttcattcaattttaaaattttgatcttttagcgcgcttgaatacgggataatttgcacttgacaacgtgttagatctgctactagtttaacatttgaaccgttttttccaatggctaaactatgttgaaaatcaggaacaactacgataaaacgacgtaatttatgacctattttgaactcttttacgcaaataacttttgaaggcgacatcgcattaacaataaatttgacaatattatcatcatatttaatcacctcaattttttcaccctgaagctcttgagaaattgcaagaactcttgagccagttgctcctacaattgagccgatttcagaaatattatcagcttcggcatcctcatttctgcgaattgcgactttacatctttcccctggaatccgtgcaattgaagtgatttcaagaaattttgactgtagttcagggattgcatcgattatttttttcttgacaagttgaactgattttgaggatatcacaacctgcgactgttttgtattttttgatacattttcaattacaacttcatgtttagtgcctatttttaaattttgtccacttgcataatggcttggcataaaggcagaaactttatcatcgtcaatttcgaaaatataaccagcagcaattttattagtaacagtggccaaaactacgttatttttaagcgataaatatttgttataaacattatttcggacaatttcagaaattttttgcttaaaagcgtgcataattgccataaaaagtcaatgttcaaaactttcaagattaatttcaattgaaaaaatatcatcaacctgaatctcaggatcagtttcttttgcctttgatagtaaaataaaagaaacaagatcgttaactttttcctcatctgtaagatcatcaaaataattttcttcaacaacaatcccgtttgtattaaaaactttaaaactcaattgttcaagatcagcttcaatttttatttgcgcatctgggtcaattttctttgttattacaaattcaattgcttcctgaaaaatatcaataactgcttccagatttaattcgctattttttgccacatcttggatagcttgaattattaattttttactatcttttgaactaatttttgatttttcggttttttttctattcattttcgaaatcttgcccttttgaaagtacttctaaaataaaatttttctcatcggtctcaattttatcgataaaaatggaaatttcttttgaaatttcctcaacttgttttaaagaccgataatcagtgataattcgcaaataatttatcccgttttctagaacaaaattaattgataaaatttgcttaaatttacttgctaattgctcaattaagctcaaatctacctcttttattttaattttatttgtttttaattataatatattaaataaaaactaaaaggtcgtcaaaaagacaacctttttttaaatacaaaaatttttaaggttgaatatattataccactttttgattaacaaataaaaataaaaaatattttttaatgtcactataatatttattcttttatggtataataatattttttatataattagttttttatcgttagtaatacaatataataatgataacgatttttatgtaaatttgtaaattttaacattttctaggcttatattaatatgatttttaattataatactagtttattccgtaagaatttccgcggtgaatcatattgaggaccacttggtttaatttttaacggcaataattttgaattctacctttgatcacctaatgcaaatcgggtacattttgcaatttataaagatccggaagacaaaattccggctgaaattattgtgatgtcaaaaaataatgatgtttggttttgccaaattaatgcctcttttaatggatattcctataatttattaattgagcatcacgatttaaaaataactgaggcacttgatccttatgcctttagtattgcgccttttgattgaaaaaaaaatgaaagtccaaaagcatatttaattgacattttttccgaaaaaactggaaaaaatccttcaaaattagaaggatttaacaaaaatccgcaaattgatgctcaaatttatcagctgcacattcgagatttttcatctattagtaaaaaaacagaaaataaaggtacttttatcggagcgctagaaaatgatgtttttagttatttaaatagcttaaaatttaattttttacaattattaccaatccactcttgttataatttcagccaaaaaaacgctagcatcctccacaaaggggatggaaacggtcattttagcacttataattggggttatgacccaattggttacttttcgataaattcaagttattcaacagatccaatggatccatatctgcgaatttttgagtttaaaaaatttgttgactccgcccataaaaataagatcggaattgttcttgatgttgattttagtcacacctttaaaaattcaattcttgaggatgtagctcacgggcatttttaccgggatgaagcagctgttttacctgccggatttccgccacttgatacacgaaaaccaatggcatttaggctaattttggattccttaattttttttactaaatattataaagttgatggatttcgctttaatttagcatcttttttagataaaaaagcaattacagttattgccagtgaactaaaaaaagttaatccaaatattcttttatatggtgatttttcaaattttagtgacctaccaagcagaaatcgacttgaaaaagggaaaacaggaaatagttttaactttggatatttaaacgatacaatccaaacagcaattatcgggagcggaaatccgcgtgataaaggtttaattttatcaaaaactagtaaaaaattcgctgcttatgtttcttcaattccggggaacattgcaaattttgacttccaaaatttgccatattcaaaaaaaaaatacgacctttttgcaaacgatatcagcctaaatcttgcctatcttacttgttataatggcccgactttagccgataaaattcttagtgcgacaacgcgaattggaaaaagagaatttcttgaaatctaccggcaagccttaatgatggtcaattttgtccaaggaaaaatttcacttagtgctgggactgaatttgctttttcaagaatttgtgatttttctgggggcagttatcaaaattgctatcctaatttaaacataaaaagaccgcctttttcgtttttagcgggcaaatatcttgattttcattctgataaaaccacagatttcacaaatggattgaattttgaaattcttaaaaacaatgaaatcaaagagaaaatctttgattttcttgccgaaattaatcaatttcgccaaaattctccattttttcggcttgatacaaaccaaaaaatcaaaaaacagctaaaatttgaaactgttgataacaataaaggattaattatctttaaaattactgctaaaaataaagtgattaaagttattcataatttttcacatctttcttatgaatatgattttaaaaattttaatattctttttagctcaaagattaaagttattcctaatttaattcagaaacatcagtcgattttattaattaaaaatagctaaattagacaaaaaatttttatttaaattttctggttaatttgaaaaatactttaattcatagataaatttaaatattatatctattttagccagaattaatttagatatattcaatagtttccactaattcggtttttttaaccaaatcaatccgattttttacaaaattgactatttcaagagcaattgctggggaagctgacaaaccaggggactgcattccggctgcaaaaataaaatttgggtcattaaaagctggtttaatcacaaagtcacttttctcagcttcgattggtcgggaacctgctaaagcaaaaaccgtttctgaataatcaaggctaggaattattttatgaccaattttttgaatttcttcattcagatcaaaatcaaggcaatttaccttatttttcgatatattttctttagctgttggcccaactaagatgtttccgtctggccgaggcgcaacaattactccttttccgtattttgaagggactaaaaaataaatattttttatattggggtgattttttaaaattaaatattgaccgcgcctttgtttttgactaaattcgccaaaaccggctatttttccgatttcatcggcataatgaccggcggcatttattataatttttgactgaaaaaaaggattattttggttttctgttttaattaggaaaaaattttgactatttttagaaattgaaataacttttgaactactaaaaaattctaaaccatttttcctagaaatttccaaaaaagcatacgcggccttaactggatctaccacccaggaattcaagcactcaagcgctaagactgcttcttctgatacatctggatgcgctaatttaagttcttttttgcttaaaatcgataagtttttagggtcaagaccgttaataattcctcgtttataaagatcgtaaattattttttcttcttcagagtcaaatgccaaaactacgcttttggctttttgacgcggaaaaataatttttttaaaaatattttcagtccataatttatggcctaaaacattgaattttgcttttaattttcctggacttggatcaaaaccacaatgaattatccctgaatttcctgttgttgtctcagatgctgggtatttttttgcttctaaaagtgcaattttaagctcaaatttactaagttcataagcaatattagttccaataattcccgaaccaataataattacatcgtaatttatattatttttttctgtcataatgtaattcttcccctaaaaacagttatataatataaattataactaaaatttttgattttaatgtttttttgttcttttattgattaaatttaattgggctttttgcacaatttttttcttaattattaacgaaggaataattaagaaaattgataaaaaaaccaaaaaaacacgtaaaatcacgagactttttgaatcatttaaaggatatgttacaagcaaaatgctcaacgaaaaaaggattatcggataataaaaaataaaggaaaaattaacaatttttaatcttatccaaataaatgatatcagaaaacataaaaaaaaatttaaaattgttattagaagcaaaattcagaaggaaattatagtttttccataaaaatcaggcgaaaaaaatgcataaataaggctaatcggaagaattattgtaagcaatgcaaataaaaaatcaggaattttcgttatttttttatacatttttttcgctgtttttcaacaaatcgacaaaatcaactagggaaattctaaataattcaggagaaccaaattttctataggtaatttcattttttgtaatttcctcatccccgattattacctgaaaatttattttttctaaatttgcctcgcggattttgcgcgaaatgcgctcagatctgagatcaatttccgaattaaatccaagatcaaaaagaattttatgaattttttgggcaaaatcattatgtttttcagctactggaataacaattatctgttttggcgagattcagaaaggtaaatttcccttgctttgttctaataaaagcgctataaaccgttcataagtgcctattaaaccgcggtgaattaaaattggagtttcttttttattatactcatttataaaggaaattttaaatttttcaggtaaaaggaaatcaagttgtaaagttgaaattgttaactctttatttagtgcagttttaacttggaagtcaattttgggaccataaaaagcagcttcaccgattttttctatataattaattttattttgatctaaaaactgctttaaatcagcttctgcctgttcccacatttgatcatcttgaaaaaatttatccttgtttttagggtctctttttgaaaatgagatataaaaaatttggaccttaaaaaaatcaagtacctcagaaatcatttgaaaaagatgactaatttcactaaaaatttgacttttactaacaaaaatatgcccttctgttaaatccatagctcgaacgcgttcaaggcctaaaagtgctcctgatttttcataacgatataatcgtgattgttcagagattcgatatggtaaatttcgataactaaaaagttgctgtgaaaaaaggataatatgatgtgggcaagtcatcggacgcggaattagctcctcgttttcaatttttaagcctttaaacatatcatcgcgataatgtaataaatgtccggaaattttatataattccttatggccaaaatggggcgtaagaacctctttaaatccgtaattacggtcaaattcaagaattttttggcgaattttattataaattcgcattccattttcaagtcaaactggaaaaccatggccaaaataagaactaaatgtaaacagttttaattttgccccgatttttcgatgatctctttcttgtctttcttgtaaaattccaagaaatttatcaagattttcttttgaatctcaactagttccataaattcgggttaactgtttgtttttagaatcaccttttcaataagcgccggcaatttttaaaagtttaaaattttgaatttttcctagagattcaagatgatttccataacataagtcttcaaaaagtatgttgtttttactatcaactattgaaaaataagtgattttttcaccttttttttctaggtcattttttaattccgctttataaatttgattttgaaaatcaaggttcttcccatcggtttcaacaatctttagattttttgaaaccaactttttcattaatttctcaatttttggaaaatcagattgcgaaattgagactgaaagatcaaaatcataataaaaaccatcatcaaaaacagggccaattccaaattttacacccggataaagaattttaattgctaatgctaagaggtgtgaacttgaatgatttaatttatagtcaatttttaagtccataaattataatcctattttttctttgattttttcaaagttagaaacagcaacttcttttgcttttttagcgcctttttttgcataaatctcgactaaatcgagatttttttgatatttttcttgtaaatctcttaaaaattcagcaactattatcccaactttttgttttaaaaactggtaagattttccctcaaaaaacgcctgagtttcatcaactggtattccagtaagtcccataaaaatgtttaaaagattggcaactccaggttttgcaaaattaaaattaacttcattataagaatctgtttgtgctttttgaattttttgatatgcctcatcaggactgtctgttaaaaaaatagtcgaattttttgattgagtagatttggacatctttttttctggatcagttagcgacataattttctgtgttctttcagaaattattgttcttggaattttaaagtcggttttataaattttattaaatctttgggcaattttccgcactaattcaagatgttgcaactgatcagcaccaactgttacaaaatctgggttatacaaaagaatatctgcagccatcaaaattggataagttaaaagtccggtgggaattttttcagtattattatcctgttttaaacgcgctttgtctttgaattgggtcattctcgaaagttcaccaattgtagtttcagactgtaaaagtcaaaataattcagaatgttggctaatttcagattgaaaaaaaagcactgttttttctggatcaaatccgcatgcaagataaaaagcaaaaatacttttacggttttcagctaattcttttggatcaattggcaaagtaagcgcgtgaaggtcagcaacgaaaataaaattttcgtattcattttgcagatcaagactaggttttatcgatcctaaataattcccaagcgttaattttcctgttgccgtaatgccagtaaccaatctttttttcataattaaaaaattttaacataatttatataaaaagttttaaaaataagtataatttaaaacataattatgaaattagtttctaaaatcatttatttttttctacaaatttttacttttggtttatttgcaaaatatcttaaaaaaaaacataataaaaagaattctgatttcacttatgaacaaaattttgactttaaaattgaggttttaattaacttgttaggcgggaggtcaaatattaaaaaaagtgattttaatatttcccgattaagaattaaactaagatcaacagaaaatcttgattttgaaaaaataaagaaattaaaggggatttcaggtatttttgttagctcagatacaataactttgatagttggtaataaatctaaagcaatttcagaagcaataaataattttggataagtttagaaatgtttaaaaaatcctaaggaaattacagtgaaaatacaaaaatttggaactcaaaaccgtgaaaatcaaaaactaaataatacaaaccaaaatttaagttatgaacgtttgcttgcaaacttaattacagtcgaaagggctgattctgcactttttactagaattgataatgaaaattatatcgatttatatggcgctttaaaattaagtgattttaaaaaattaattaattcaccgatctcatcagtatcacttgcatcaaatgaatttgatgattttagtgaaaaaatcgagtcaataaatacaaaggatgaactagttgaatttctaaaaagttcagattataagctaaatccgcttttattaagatcgttaaatactgattttgaaggtggaaaaaaggaaattttaagtaaaatttcttataaaaaacaaacaagcctagcaaaatggaagcgactaattaagaaagcttatgatattttaagggacagaaatatatggccagtccatatcggttttggatatatttcgcttacaattgaagatagaagtttttttggtcctttatttgtcaaggaatgtgaagttactattgtaaactcagtaccaagactaaacgctgatggacatataaaattgaacgctaaattgcttacttttttaagaaagctcgatatagattttaattttgactttgatttttccgaattttcaattacggaattaatggaaaatgtaaaaaaattctataatgataaatttgaaatcccaagtattgaaggtaaaattcctaaggaatttgcaacaagtgaagatagtataaattttcatcctggtgccgttttaggattttttaacattggtggctcacaccaacgaagcattatggaaaaaatgataaaaacaggcgaaattcacaacctaattgaagttgatattaataaaactggttatcggacagcaattgaaaaatcaatattttcacctaaatttacaggattttttaaaatccaaccaactaatttcacacaggattatgcccatatttcagcaattttgcaaaatacaattatctgaggccccccaggaaccggaaaatcacagacaattgcaaatataatttctaatattatcgcgctaaataggacagctcttgttagttcacagaaaaaaattgcgcttgttgtcctaagaaaaagactgaaaatgatgtcatttttctgcctttttgtcattaatgaaaaacttgaaaactataaggatttttataaaccaattgaagaatatattgaaattattgaaaatttcaatatggaatccaaaattgatgaaatcaaagttttctctgatgatgatcggaaatatttagaacttttagctaacattttcccaaaaactgacattctcagaaacactttagaggcttataaaataattgaaacagccaataattttttcgcccttaatgttgctgaagcaatttttaaactaaataaatcaataaaaattaatccaaaaagatcgccaagaacagaaactaaactaaaattgcatattgtcgaaactcaacttaaaagaaaactaaaaatttatgaaaaagcacttcatagtgtttcaaaagatttacgggaagatgtaaatttaattcttgaaaatttagcaaattatgatgataatctagaaaatatttataataaaatttcaaaattggaaatttccaattttgaaaaccttgaaaaattcctgaatttttcaagaaaaccaaaagttgaagttcttgatgataaagctttatttatttttcatgcaaaaaaagtatttgaaatccttgctaaattaaataatgataatgaattccaacaactttatactcgttttcgtttaagtgtaaagcagaaaaagaaaatgtcaccttataaatttttactaaaacattctgaaattattaaggttttatttccggtaattattacaacccctgacattgaacttataatgtttgagaaaaaatattttgattatgtaataatcgatgaggcttcgcaaatgttccttgaggaagctttgcctcttttattttatggaaaaataaaagttttagttggtgatcaccaacaaatgcagccgattcgttgatttgcctctaaaataaatgaagaatctgaagatgatgcctttgcaaatattgaatcaatcctagaatatgcccattctaaaggtgtttttaatattatgttagataaaaattatcgctcacatcatgcttccctgatgacttttaactcacgccatttttatgaatcagaactaaaaattgcaaataattacaaatttgaaggcactgatgtaattgaagttcaaaatgtaaatggccaatgagatggacaacaaaatcttgttgaagccaaagccgttgtcgaaattgcccagaaaaatattaacaaatttccaacaatgatcattctggcctttaataaaaatcagcaaaatgcaattgaaagaatcatttttgaatcctaccctgaaattgaaaaattaatttatactgataaaattatcgttaatagtcttgaaaatattcaaggagatgaggcagatttagtaataatttcagttgcatatgaccaaagtgcgaaattcgtttctacttatattgcaagaaaaggtggaaaaaacgccctaaatgtagctacttctcgcgcaagacaaaaaatgataatttgcaaatcaataaatgctgatgaaattcagaatacttcaaattctgaagatcttgaaatttttaaagaatgaattaactttttagaccttgatatccaatcacaaattcattattcacgcaagaaaaagacagaactctcacttgctgaattacaaaatgtgcaaaaatctagattttttactgattttcaacaggaatttattgaagaatttagcaaaaatttccctgattttgaaacaaaaacaaattttgctatcggtagcgaggaaattgatgtagctatttttgatcagagtcaacttttatttgcagtctaccttgattctttagaatacaaagacccaaaagaatatattaaatattttgatgctatcaagtttattgaagaaaaaaaataccctgttttcattcttaattttgttgaatggaagctaaataagcaaaaaataatgaccaaaattaaagaaaaaattcttactttgaaagaagatgatcttgtctaaaaaccaattatatgctctagatgacttagttattggttgtgatgaagttggagttggtgaatattttacaaatttaactgtatgttgtgcagtttttcgtgaaaaagagattaaaaatgaacttttaatacaaatagttgattcaaaacttttaacagaaaaaaaaatttctgatctttttcaggttataaacatagaccaaaaaataaaacataaatttaccagtcttgaaatgaatgagtataataaacttattgaagatggactaaattcacatcaaattaagtcacttttgtattttcgagttttaaatgatttgattttgaatcttgaaaatgaaaaaattaataaaatttttattgatggatttgtaagtgaaaaaaagtttaaggaatattttgcaaaaatagcggaatttttaaaaattgaaccttgagattttcaaaaattcccacttatcttagaaaaaaaagctgatacaaaaattaagcaagtaggcgcagcctcaataattgcaaaatttgctttaagtcaaaaatttgctaaaaggcaagagaaatgaaaggctgtttttcctgctggttccaatcagattgaaaaaattgttaatttttgtgttggtcaaattgaaaaatatggcaaaatttttcttgaagaaaatgttaaacttcattttagtatcactgaaaaaatttatgcaaagttagaggaaaaaaatgggaaaaataattaaattattcgctgaaagcactgaaaaaatcgccacaaatatcaatgttgctggcggagttggtcttggtggctgaatcggaattacaatttcggttggaattattctttttattgttggtggaatcattgctcttgttgtttcaaaaaaaatgtttgaaaaacaaataagagaaaatcctccaataaccgaaaatatgatcagggcaatgtatatgcaaatgggtagaaaaccatcagaagcccaaattagagcagtaatgcgctctgtcaaaaatgcaaaaaaataggaaaaatgtgaaaaaaaaattagttttaattattattgacggacttggattgcgccttgaatcccaaggaaatggttttgcactggcaaaaacacctgtttttgatagactttttcaagaatatccaaatagtttaattgctgcttctggtcaagaagtcggacttcctgaaggtcagatgggcaatagcgaagtcggtcatttaaatattggcgctggttttgttgtctatacaggtatttcaattataaataatgctttaaaaacaggtaagttttttgaaaatgaaaaatttattttagcctttaggcatagtatcaaaactggatttccgctgcaaattatgggtcttttttcacctggaggggtccattcccaccaagatcatctttttgccctgattgattttgccgctaattttggggttaaaaaactaaatcttcacctttttggtgatgggcgtgatgttggcccaaagtcaattaagccctgaattaaaatgttaaatttaaaattaaaaaattatgaagattataaaatagcttcaatttctggccgtttttattcaatggaccgcgataaaatgtttgaccgtgtcgaattaggttataatgcacttttaggaaaagcagaaaataccttcactgatccaattgattatatcaactttcaatatgaaaaaggggtaagtgatgaattttttgaacctgcaattaacctcaaagtcaacaagaaagattttttagctgatgatcatccagtgatttttttcaactttcgacctgatcgagcaaggcagctaagccacttaattttacagactgatttatatgaacaaaagccaaaaaatcctataaaaaccgatgtttttgtttcaatgatgaaatatgaaggcataaattgcctagtcgcctttgaagaaatgagagtcgaaaatcctttgggaaaattaatttcaatggctggatttaggcagcttcgactagctgagacacaaaaatatgcccatgtcactttttttgttgacggaggtgttgaacttgaactagaaaattcagatagaattttaattgattcactaaaagtgcaatcatatgctgattttccacagatgtcagctgttgaaattactgataaacttcttgaagttgggcaaaattatgattttatcatcatgaattttgcaaatccggatatggttggtcataccggagatttgaaagcaactattaaggctgttgaaattcttgattttcaaattggtagaatttgcaaatgggcagaagaaaaaaattttgactttttcattaccgctgatcatggaaatgctgaattaacagaggatgaaaacggaaatccgtcaacaaaacacacaacttttccggttatgttaatttcaagtgataaaaccatcaaactaaaaagcggaaaattagcaaatattgcaccaaccattttggactatttaggacttgacaaacaccctgatatggaccatgattctttgattattaaagacaaataatttttctttatttgaaaaagtgtcctaatttatagtattttttaaaatccaccaaaaatttattttttctttttctttttttttttttttttttgataaagttacattataaaaacgtattatctacttagataaaatactaaaaaattggagtaaacaaaaagatgaaaaaaagtaagaaaaatttatttaaaaaaataatcaaaatttctctttttggtattttttcaactttatttgtaatttcttctactaatgacaatctacaaattcaatctgttattagtagaagaaatacggaaaattgaagtgaaaagtctcaaaacacatataaagttagtcaaatggcttctgttaataacgttgacgaagatgaaatttcaaaagcaattctaaaaatcaaaccaagagaagatgagtttgtcccagcaatcccacttttatttggggcgcttggtggaattctatttggcgggttattttcaagttgacttagccaaaatccactacccgaattacctcgattgggcaatgttggctcatatgccccacaaattgaccaaaaaccaagtcaaaatactgagaaaaaagtatcaaaaaggtatgaaaataattcataccaaagttcttttcttgattatttccaaaaaactgaaaaaaaatctaaaattgataattctggacctgtatatgggccatttttgcctggcgaagataagcgcgaactcgacccaattgttgcaaaaagtgctaattcaataacaattgatcttaatattttatcgataataactaaaacaaaattatcagagagagttgcagccttaagcagagtcgaatttgtcgaaattactgatagaaaaaaattaaaagattataaagatattcatcttgcatacttttttgacgaagttccaggtggaaaaccaaaatttataattagcaaaactaaaattagtgaaccggttgcttgggagctttcaattttaggtctgcaaattgaattaggaattccagaaattttagaaaaaaatttcttcccaaatattcgattacaaccattagatttaatagaaaaatttctgaaaagactaatgtttagacctaatttttattcttataataaacataaaatgcagcaattagcctacaaaattgccgccacaatcaacacaataaattatggaaatttaggatataatgttccatatttaaataatgataatgatccaaattatcccaaaagttattatattgttgaagatttttatgaagaaatatttgataaaaacgaaaattgatacataaatatgccatcgggggaaacgtgatatttggatggaaaggaagaagacccagtcgagagagaaaaccagagaaaaaaaatagcgaaaaaaagtattttttttaaaaattaccatgttagacgatataaattgcatcctaataataagaaagatagagtttgagaaccaaacctaaaaaaagttgaaggaattcactatttatatggagacccagtcaaattcccttattaaaattaaagaaaaattcctagaaaatagatatcgagaagtaaatatccgagattttttttcaacaagaaacatttatatgcactggaaagaaccttatatttgggttaatggagagaaaaaatttaactgtttttctatttcgtgttattgtgatgataaatttgatccttttttggagattaacggcattccatcatataaaaatacccgcaatccaattgaggatatgatcgcaattccttataaacaaggcgattatatttatcgacttcgtctggatgaaatccaaaaagctacttttttttcaaaagaattaagattttttaaattttataaaaaatcaatttctaaagagatttataaaataatcagcgagagatatcatcgggtttcaaaatctcgttgaaatcttgatggtattttttgagataataactcctgaaatgatataaaaatggtggtagttgcaattgaaaatatcgaagatgctcagaattgtcaatattcaatttcttttccttcaatttttagaatgagttatacaaataaaacaaggcttaaagaagtcgagcaactaataatcaatgaaattgaagaattaattccgtatgcgaaaccgaaaaatcttgaaaatcacagagaaaaaatttttgattttttgtcaatccaaaatgagtataattccaaatattttgatccagataagatgtatttaggtgttaaaattgagggtgatttaaaaaagatcgaaaaagaattccaagattttgaagctaattacccacttgtatttaatgtaaaaactttagaaacttatgaaaaaattttagaaaaatttaaaaaatacaatattaagaaatttgatcttgaaaaagacgacagaaatcaaattttaattagttggcttgacaaatttgggccggaatatcaaaaacattgtattaatctattcggaaaagatggtgaaaaatattatgatgaacttgaaaaatggacaaataaaataaatctaatccaaattttccaaattatgtttggacctttaatctattttatatgaacatataaaacatcacacaccctcaaaccagatgctgttattttaaaaagttggggttgtcttaatccttcaaaatttgaattatattattttggaggtcccgaatatggaatttatgatgaaattctagaaaaatttgactcaaaatatcctgttttctgagtaaataccgcgtatgaaccgagtggtcatagctcaacaaatggctgaattcccgatattattacaaaaaatttaattttaattcaccgggatggcgacaatgttttatactgaattggaaaatcaccattttatcatcatgtttataatgggaaatattttccattaaatttatattataacaaaaaaatttctgatattgaaagagatatttttttgcgcgaaaacaaagatccggaattttattcatatgattataatttatatattgatgtaattagaagatcaaattctgaattaagtcaattatttgattatattaatttatatgaaaaaaaatataaaaaagataatccaggtaaaagttttcaagattttttgcataaatctgatttgcttactaaaagtgcaagaagaagattatcaaaatttgagctaacaacattttataaggtttatgaaaaaacagttaattatattgactttgataaaaatgaatattatgattttaggttaaacgcaatttataaaaaataacggtaattattatgtttttttaatttataagatttaatttatctaatttttcctaattcagactaaaaatataagcaataaaacaattaatacaagcctaaaatttataaaaattttgttttttctgataaaatttaggtattacaactagttttttgctataaaaattagtcaaaaaaagactaagaaggaggacggttatgaataaaaaaagtaaaaatttacttaaaaaagtctgcaaaatgttctcttttgcagcattttcaactttaataataacttcttatagtaataataatttccaagataaaactccgtctagccaaaaaataacagaaaatttaagcaaaaaatcccaagaagtcaataaaatcagccaaatggcggccgttaatgaactagaagatgaagaaatttcaaaagcaattttggaaattaaacctagagaagatgagtttgccccagcaatcccacttttatttggggcgcttggcggaattctatttggcggggtattttcaagttgacttggccaaaatccactacccgaattacctcgattgggcaatgttggctcatatgccccacaaattgaccaaaaaccaagtcaaaatactgagaaaaaagtatcaaaaaggtatgaaaataattcataccaaagttcttttcttgattatttccaaaaaactgaaaaaaaatctaaaattgagaattctggacctgtatatgggccatttttaccgggcgaagataagcgcgaactcgacccaattgttgcaaaaagtgctaattcaataacaattgatcttaatattttatcgataataaccaaaacaaaattatcagagagagttgcagccttaagcagagtcgaattcgtcgaaattactgataggaaaaaattaaaagattataaagatattcatcttgcatacttttttgacgaagttccaggtggaaaaccaaaatttataattagcaaaactaaaattagtgaaccgattgcttgagagctttcaattttaggtctacaaattgaattaggaattccagaaattttagaaaaaaatttcttcccaaatattcgattacaaccattaaatttaatagaaaaatttttgaaaagattaatgtttagacctaatttttattcttatagtaaacataaaatgcagcaattagcatacaaaattgccgccacaatcaacacaataaatggagcaaatttaggatacaatattccatatttaaacaatgataatgatccaaattatccaaaaagttattatattgttgaagatttttatgaagaaatatttgataaaaatgaaaattgatatataaatatgccatcaagtgaaacatattatttagaaaacccaaaaatagacccaaatagaactaaaaatatctgaaagaaattagaaaaaaagtctattttttttaaaaactaccatgttagaagggttaaattcaaaccaagtgatagagaaaaaaatgaaaaaacgggaaaggatataagacatagcgacctaaaaaaaatagaaggaattcattatttatatggagatccagttaaattcccttattaaaattaaggaaaaatttatcgaaaatagatatcgcgaggtgattccgcgcgattttatttcaacaagaaatatctacatgcactgaaaagtgccacctatttcggaaatcaatggtgaaaaaatagttgactgttggcctcctttaccttattgtgatattaaatttatgccatttttagaatttaacaattcttcctcaagtttgggattgcacaatccaattgaagatatgattgcaattccttacaaacaaggcgattatgtttatcgatttcggcttgatgaaatccaaaaagctacttttttttcaaaagaattaagattttttaaattttataaaaaatcaatttctaaagagatttataaaataatcagcgagagatatcatcgggtttcaaaatctcgttgaaatcttgatggtattttttgagataataactcctgaaatgatataaaaatggtggtagttgcaattgaaaatatcgaggatgctcaaaattgtcaatattcaatctcttttccgtcaatttttagaatgagttatacaaataaaacaaggcttaaagaagtcgagcaactaataatcaatgaaattgaagaactaattccacatgcaaaaccgaaaaatcttgaaaatcatagagaaaaaatttttgattttttatcaattcaaaatgaatataattccaaatattttgatccaaataaggtgtatttaggtgctaaaattgaggatgatttaaaaaaaatcgaaaaagaattccaagattttgaagctaattacccacttgtatttaatgtaaaaactttagaaacttatgaaaaaattttagaaaaatttgaaaaatacaatattaagaaatttaatcttgaaaaagatgacagaagtaaaattttaattagttggcttgacaaatttggacttgattacaaaaaacattgtattaatctattcggtaaagaaggggaaaaatattatgatgaaatcgaaaaatgaactcataaaataaatctagtccaaattttccaaattatgtttggacctttaatagattttgtttgaacgcgctcaaattattacataaccaaacctgatgccatcattttaaaaagttgaggttcgcttgatccttcaaaatttgaattatattattttggcggtgtggaatatggaatttataatgaaattttagaacaatttgactcaaaacatcctgttttctgattgaatactggttatgaaccaagtggaagaaccggcacaaatggctgaattcccgatattattactaaaaatttaattttaatttaccgtgatggggaaaatattttatactgaattggaaaatcaccattttatcatcatgtctataatggaaaatattttccgctaaatttatattataacaaaaaaatttctgatattgaaagagatatttttttgcggcaaaacaaagatccagaattttattcatataaatatgatttaaatatcgatgtaattagaagaaccaacgagcagttaagcaaattgtttgattatattaatttatatgaaaaaaattataaaaaaaataatttaaatgaacattttgaaaatttcttacacaaatcggacttattaactaaaagcgcaaggagaaaattatcagcatttgaaagaacatcgttttttactaaacacaagaaaactgttaattacattaatcccgaaaaaaacgaatattatgattttagattcaatgcgctttataaaaaataactgtaattattagtttttattattattaaaaaaatcgtgttgctaaatttttgttatttttgatgcttttttggtttaaaaagaggggtaaaaaggttatcagaaactaaaatcgtaatacgattacatttaaacacgccaaaattaactctcaaaaacgtgttttttagttttaaaaagaatcaaacctaaaaaaagttgaaggaattcgctatttatatggagaaccagtcaaattctcttattaaaattaaggaaacatttttagaaaatagatatcgagaagtaaaggtccgcgattttatctcgacaagaaatatctacatgcattgaagagaaccttatatttgagaggtgaacggaaataaggaattgcgttgtcttccttattattgtcagcgtgaatttattccttttttagactttgctgccactagttcctacaaagacggccacaatccaattgaagatatgatcgcaattccttataaacaaggcaattatatttatcgacttcgacttgatgaaatccaaaaagctacttttttttcaaaggaattaagattttttaaattttataagaaatcaatttctaaagaaatttataaaataatttatgaaagatatcatcgcgtggcgaaatctcgttggaatcttgatggaattttgtgggataataactcatgaaatgatataaaaatggtggtagttgcaattgaaaatatcgaagatgctaaaaattgtcaatattcaatctcttttccgtcaatttttagaatgagttatactgataaaataagactaaaagcggccgaacaattaataattgatgaaattgaagaactaattccgtatgcgaagccgaaagatcttgaaaatcacagagaaaaaatttttgattttttgacaattcaaaatgagtataattctaaatattttgatccaaataaggtgtatttaggtgctgaaattgaggaagatttaaaaaaaatcaaaaaagaattccaagattttgaagctaattacccacttgtatttaatgtaaaaactttagaaacttatgaaaaaattttagaaaaatttgaaaaatacaatattaagaaatttaatcttaaaaaagatgacagaagtaaaattttaattagctggcttgacaaatttgggccggaatatcaaaaacattgtattaatctattcggtaaagaaggggaaaaatattatgatgaaatcgaaaaatgaactcataaaataaatcttatccaactttttcaaattatgtttgggcctttaatcaattccatttgggaactttttaaatctcgtatgattaaaccagatgctattattttaaaaagttgggctacacttgatccttcaaaatttgaattatattattttggaggccccgaatatggaatttatgatgaaattttaggaaagtttggttcaaaaaatcctgttttttgattcgcaaccgcatattatccaagtgatcaaagcgcaatgaatggctgaattcccgatattattattaaaaatttaattttaattcaccgtgatggggaaaatattttatactgaattggaaaaagtccattttaccatcatgtctataatggaaaatatttcccactaaatttgtattataataaaaaaatttctgatattgaaagagatatttttttgcggcaaaacaaagatccaaaattttattcatatgataatttatatattgatgtaattagaagatcgaattctgaattaagtcaattatttgattatattaatttatatgaaaaaaaatataaaaaggataatccaaagggaagttttcaaaattttttacgtgaatctggttttttagctaaaagtgcaagaagaaaattatcaaaatttgaactaacaacattttataaggtttatgaaaaaacagttaattatattgactttgataaaaatgagtattatgattttagattaaacgcaatttatgaaaaataactgtaattattatgtttttttaatttataagatttaatttatctaatttttcctaattcagactaaaaatataagcaataaaacaactaatacaagcctagaaatttataaaatttcattttttgtgataaaatttaggtattacaactagttttttgctataaaaataagtcaagaaaagcctaagatggagtgtgatgaataaaaaaagtaaaaatttacttaaaaaagtttgcaaaatatttctttttgcagcattttcaactttgataataacttcttatactaacaatagtttccaagataaaacttcgtctagccaaaaaataacagaaaatttaagcaaaaaatcccaagaaatcaataaaatcagccaaatggcggccgttaatgaactagaagatgaagaaatttcaaaagcaattttggaaattaaacctagagaagacggttttttacctgccattcctcttttgctaggtggttttggtggaattttgtttagcggattatttgcaaattgatttagccaaaacccactaccagaattgccacgaattggtggtcaccaatcatattcacctcaatttactgaaacatcaagcgaaaacaacaagaagcaaccattaccaaaaaaaccagaaaaaacttttgaaaataatccttgatttggcccaacaaaaatttctaaaaatcaaaaattaattcctaataattgactacaaaatgatcaaaattctagtgaaaatcaaaattggctatctgcattttcaaacccaaaatccgaaaaacaccaaaaatctggtccagtatacggtccttttttaccaggtcaagacaaacgggaactaaatccgattataacaaggacgcctaattcagttactattgatttaaatattttggcaataaaaactaaaactaaattatcagataaagttgcaactttaagtagagttaaatttgttgaaataacaaacaaggacgaactaaaaaagtataacgatattcatcttgcttattttttcccaggtattggaaattataaagcaaaatttataattagtgaaacaaaaattagccagcaagcagcttgggcactttcagtttttagtctccaggaaagcatgggccttccaataattttagaagaaatttttttcccgaatttagagtcaaattcatcaattgtagtcgataaagttaaaagattattgagttttaagtctgatttttattcatatagcaaaacaaaaatgcaacaattggcttacaaagttgcatcgacaattaacataataattggtgctaaatttgcttataatgtcccatatttaaatgatgataatgatgaaaattacccaaaaggttaccttgttaaggaaaattttattgataaaccttttgatatggaagaaaattgataccaaaatatgccatcagatgaaacatggtatttaaatgggaaggggataataaaaaaaagagaggaagagattaaaaaaaggttgaagaaaaagaaatttttttcaaaaattatcatgttagacgagcaaggcttcatccaaaaattaaagatgaaaaagcactaaaaggtgaaaaaatcaaatttgaaaaactaaaaagagtagaaggaattcactatttatatggagaaccagttaaattcccttattaaaattaaggaaaaatttattgaaaacagatatcgagaagtaaatgctcgcaatattctttcgacacgaaatatttatatgcattgaagggaaccttcaaattcagctaatggccttaaggatttccggtctcaatgcagacttacatattgccatcaagaatttatatcttttttaatttttaatgctacagagtcagataaaattggccacaatccaatcgaagatatgattgcaattccttacaaacaaggcgattatgtttatcgacttcggcttgatgaaatccaaaaagcaacctttttttcaaaagaattaagattttttaaattttataaaaaatcaatttctaaggaaatttataaaataatttatgaaagatatcatcgggttgcaaggtcatgttgaaatcttgatggaattttttgggataataactcttggaatgacataaaaatggttgtaattgcagttgaaaatattgaagatattgaaaattgtcaatattcgatttcttttccttcaatttttagaatgagttatacaaataaagcaagacttaaagaggtagagcaactaataattgatgaaatcgaagaactaattccatatgcaaaaccgaaaaatcttgaaaatcatagagaaaaaatttttgattttttatcaatccaaaatgagtataattcgaaatattttgatccaaataaggtgtatttaggtcctgaaattgaggatgatttaaaaaaaattgagaaagaatttcaggattttgaagcagattatcgccttgcatttaatgtaaaaactttagaaacctatgaaaatattcaaaaaaagtttaaaaaatatggaattaaaaaatttgacctggaaaaagacgatagaagtaaaattttagttagttgacttgacaaatttagtaaggaatacaaaaagcattgcatcaatttattcggaaaagaaggcaaaaaatattatgatgaaattgaaaaatgaactaataaaatagatcttattaaactttttcaaataatgtttgggccaataatcaattttgttggagcttattcaaactattacatagcaaaaccggatacaataattttaaaaagttgagcatcgcttgacccttcaaaatttgaattatattattttggtggaccagaatatggaatttatgatgaaattgtgagtcaatttgattcaaaaaatcctgttttttgagtaaataccgcgtatgaaccaagtggttatagcgacacaaatggctgaattcctgatattgttattaaaaatttaattttaattcaccgtgatggggaaaatattttatattgaattggaaaaagtccattttatcatcatgtttataatggaaaatatttcccactaaatttgtattataataaaaaaatttctgatattgaaagagatatttttttgcgcaaaaatagagatccaaagttttactgatataaatatgatttaaatattgatgtaattaaaagatcgaattcagaattaagtcaattatttgattgtattcatttatatgaaaaaaaatataaaaccaatagctcaaaaaaacattttggaagcttcctacataaatctgattttttaactaaaagcgcaagaagaaaattattaaaatttgaaagaacgtcattttttgaaaagcacaaaaaaacagttaattatattgactttgataaaaatgagtattatgatttcagattaaatgcaatgtataaaaaatagcgctaattattatgttttttaattttatagttctgatttagtttattttgctacaaaaaagttcaaaaaatagtgtttgtgggttcaaaatttagtaaaaaaactattttttagtgtataattctattctagatacatatatttttttaagtcttttagccaccaaaaaaaaaaaaaaaaaaaaaaaaaaaaaaaaaaaaaaaaaaaaaaaaaaaaaaaaaaaaaaaaaaattatatggtataatattaattataagagtaacaatagcaaaagggatcacctgaatccattccgaactcagtagttaagcctttttacgccgaagatactagaaataggaaaatagggagttactctttttttttttttttttttttatgtaaaagagtttagaaatggcatcttttagccaaaaaattaaaattgaaattctctcaaaccggctttcccggccaaaatttttttcgttactaaaaggtttaatttttagtgcttcaaaatttgaggattcaaattttttcatcattagaattaatagaaaagagatttcaaatagattacgtgaaatttttcaatattttcaattaaaatttctcgatacaaagataaataaaaattgaatttgtgttaataaaaaggtaataaaaatccaaaaaaatccacataatatacaatatttttttgctggcctttttattggtggagggtcaatttcacatcttgaatcaaaaagatatcatttagagatttcgttcttagataaagaaaaatgtgaaaaagtcagtgaaattctacaaaaaaatgaattagagtttacttttcgacaaattttccaccaaaattattttaggttatatttaaaaaaggttaacgaaattatttactttttaatggtaataggagcgctggaacaagcatcaaagcttgaaatcttaagaattaaacgtgatcattatttaaacgcaaatcgtattactaattttgatattagtaatgctaagaaaatatctagttcttcagcaaatttcactaaaaaatgaaatttaattcagaaaaacaagttaactgcattttttagtgaaaaagaattgatcttcttcaatgtaagaaccactagacctgaattaaatttacaagaaatttccgaaattttaaaaaagatgtataatattaatataactaaatctggtctaaattattgactttctaaaatgaataaaatacttaagaagaaagaaggagaaaaaaatgaacaataaaattacttacaaccagcgcgactttaaagcatatagtcgatcaacggcctatattcaaaaacaaacaaatcgtttgttaggttattccttattttgacttggaattgccattttatttattggtttattaacttttgcgattttatcaattgatgcactttttgatttatatcaaatttttgtgttttcattattttcaagtatagcaacaattattttaattactcttttaatattaggactaaatttttgaatttcctgatatatcggcaagaatgccttagccgaaaagccgtcaactgtttttttaggttttctattttttgtttttataatcataaattctcttacgctacctttgttttttgctttccaaataattcaaggtaattctagccttgtaatgcttgcagttgctggcgcaggagtaattatggcagtcgttggagctcttggttatttcaatataattaattttggaaaacttctgcctttaattatagcgggaataataattcagtttgtaattggtttagcgacactttttatcttttctacatttttagaaactttatattcaatcatcggaattaccgtaactcttggaataattggttatgaattttggcttatccgcaatcagtcatgccaaattcttgctttttatacagacgaggcagaaattaaacgcgtttttttcagaattgcaatttgaaatgctcttggtttatatatttcatttattcgtttagttatttttataacaagaattatggcttcaaggtattagaaaaaataatctaaaaaacttatttttaaaggatattttataaaatataaatggaaaataaaataattttagttgatattgagataagtaaaggttcaaatataaaatatgaacttgattctaaaacaaaaaaattagtagttgatcgaattttatatggtgattttgtctacccagcaaattatggtagtattccaaaaactttagattgagatggcgatgctcttgattttttagtctattcaaatcaaaaatttctaccaggaacccaattaaatgcaagacttttaggggctcttgaaatgattgatgatggtgaaattgatacaaaattaattggtgtccataatgatgactaccgttttgatcatataaaatctcttgatgatctaccgcaggaatgacttgattcgatttattatttttttagcaactacaaaaattgaaaaaaacccggaattactaaggtttcaaagtttctcaaatatgagcaagcattaaaagaatataaaacttgccaagaattatttaataaatataaggactttaaaaaatctgaatttttaaaattaatgatggaacaatttcctgaaaaatatcaaaaataatttcagaaaaatttgaatttttgtaaaaaccaaataaattttaaattttatttggttttttttctttttaacgaaattatttttgtaaataataaatttttgctttaatatacaaaaaaaaggattaaaaaatattggaatttttaaaaattttttagtttttgtaatataatagaaaatgtaaaataaaaattaatttattaaaaaataattgaaagtcatcgtaattaaaacaattaattaggagaacaactatgaaaaaaaagataaaatgaaataaatttcttggcttaggcttagtttttccgctttcagcaatcgcaacaatctctgccggatgttgggataaagaaacaactaaagaagaaaaatcagccgataatcaaaataagcaaatcactgatgtctcaaaaatttcaggactagttaatgaacgaaaatccgaaattatggccgcaaaagctgatgcaaacaaacattttgggctaaatatggcaattgtagccgctgatggaacggtaaatgataattcatttaaccaatcaagttgagaggcaattcaacaacttggcgctcttactggaggtgagattacttcagtagatagttcaactgctgaacttgaaggaaaatatagctcacttgctaataccaacaaaaatgtttgagtactttctggttttcaacacggtgatgcgatcacaaactgattaaaagtccctgaaaataagcaattatttactgaaaaaaatattatcatactcggaattgactgaactgatactgaaaatgtaattccaacaggtcgatatattaatttaacctataaaactgaagaagccggatgacttgcaggatatgcgaatgcttcctttttggcaaaaaaattcccaagtgatccaactaaaagatcagcaattgttatcggtggtgggatttcgccagctgtaactgattttatcgctggttatctagccggaattaaagcttgaaatctaaaaaattctgataaaaaaacaaagataacaactgataaaatcgagataaatcttgggtttaaggttcaaaatacttcaacaaaagaaagacttgaacaaattgcttcaaaagataaaccttcaacactattagctgtcgctggaccacttactgaaattttctcggatataatcgcaaaccaaaatgatcgttatctcattggtgttgacaccgaccaatcacttgtttatacaaaaactaaaaataaatttttcacctcaattttgaaaaatttaggttactccgttttcagtgttcttagtgatttatataccaaaaaatcaaattcaagaaatttagccggctttgaatttggtaaaaaaagtgcaactgtttatcttggaattaaagacaggtttgtcgatattgctgatacttctttagaaggaaatgataaaaaactcgcaactgaagccatttctgaagctaaaaaagaatttgaagaaaaaactaagacaattcctgccgaagaagttcgtaaaactttagaaattccggaaatgcctgataaacaacctgataagcaacaggaaagcttagacaaactaattaccgatattaataaaaattaagtaagaaaaaataacaattttttaacattatatctttttttagagattaattttcttctaatttagtttaatttaatataaaattatattaaattaaaaaaataaaaaatccggactatttttgttccggattttttatttttgtgttactatttaatataatgataaatcaggattatgcaattgaatttattcaagtctcgaaaaaatttggcagtttttatgccaattacaaaatagattttaagattaaaaaaaacacaattcatgctctaattggcgagaatggtgctggaaaatcgacacttatgtcaacactttttggaatttatacccctgatgagggccaaattagagtcaatggtaggcaatcttttattgataatccaaatcgcgcagcagattttggaatcggtatggttcaccaacattttaaacttgttgatgcatatactaattttgaaaacattattttaggtcaagaatttagtcattatggcattatcaaccgtgaaactgcaaggcaaaaaatcaaaattttacaagaaaaatacaatatttccttcgatttagatcaaaaaaccggtgatgcctctgttgttattaagcaaaaaattgaaattataaaaattttataccgtgattcagatattttaatttttgatgaaccaactgcaattttatcaccacaggaaattgactcatttttagaaattctgaaattttttgtcaaaaatgggaaaactatcatttttatttcgcataaattattagaaattaaagaagttgcaaattcggccactgttttacgggcaggaaaagtcgttgctaattttgaaagtcttgaaaatgttacaatcacggaaatggcagcggcaatggtgggaaaaactgttgttgaatcaaaaaatactagtgaatgccactttggccaattaggcttaaaaattgaaggtctttctgctaaaactgataaggaaatcgttgatttagaccttgaaattcacaaaggcgaaattcttgcaattgctggaattgaaggaaatggtcagttagaactagaacttgctctttccggtcttatagcctcaaaaggaaaaattcttgtctatgataatgaaaataagcctataaatcttgaaaatttaggaccgttagcccgttttggtctaatttcttatgtacccagtgatcgtcataaatatgcaatcgtccttgatctaccaaacctagataattcaattattagaaatttacgaaacgaaaattttgttaaaaaaacgtatatcaaatcacaaaaagtgcaagaattatatgcagaaattctcaagaactttgatgtccgcggtgatttaattggctcaagaaattctagacttttatcaggaggaaatcaacaaaaatttgtcttaggacgcgaaattctaactccccatgaagtacttttaattgttcagccaacccgaggactagatattggtgcaattaatctcgtccaccaaattattttagaccaaaaacagaaaaataaagcaattttactaatttcttatgaacttgatgaagttttagcgcttgcggatacaatttgtgtactcaataaaggccgaatttccaaaaaatttatgcgcactgaaattgatcgctataaaattgggcaactaatgggggagtaaaaatgatgaaaaatttagttaatccgctgcaattttttttcaaaaaaattgacaaaattagtctaaaaagttcttcagaaaagattttttcgactctttgggcgatttttttcggaattttaatgtcatttatttttattcgcgccttcggctataacccttttaaagtttattatacaatgttttttaaaattgcttttgctaaaaatcagattcgaaatctgcttttgacaagctcaattttcatttttgccagtattgcaattgcgattccttttaaagctggactttttaatattggtgcgcccagtcaaatgatgatttcaggggctatttctttgctagttttcttgaatttaacctcaataaatatttatttacgtttgtttttaggtgcttttttgggaataatggcaagtggaattcttggttttttagttggaattttaaaatcctttctgcgaattaatgaagttatttcgactatcttattaaattgaattatttattatataataaaatttttgctaacttcaactaatttagatatcggttttatctcaaattcaccacttacaagtaaatcaattagtgagacaagttttctgacttcaatttttctaacaagaaattttgcggtaataatgttatttttaggacttatttttgcttttttaatctgatttattatgcagaaaacaacaattgggcttagaataaaaattactggacaaaataaaaatgttgcatcttatgctggaattaataataaaattatgactatttcagtaatgagcttttcaggagtaatcgcaggaattgctggatttatttggtatattttttataaacgatcttttacacttagtagcgggatgccccgtgaaggttttgatgccattttggtgacacttctagcctttaattcgccttttgggataatccctacctcctttttttattcaacactttcaatcggcgccagcgcccttgagtcacactcaattcgtttaaatcaggatacaatgcaaattgtgattggaattattatttatttatcagcaatttcagttgtttttgttaattttcagccaataaagtgaattttaaatttctactttttattaagttcgcggcaattttttggaccgaaaacagtaaaatttcgctcattaaaattagaaaaatctaagtttagttggttaaatttagttggtctaaaaaaaattgctcccgaaaaaattgaggaaattaactatgaaattaataatttagaaagtcggcgaattcaatatttagattgatttttaaatgataaaataaatattttacatatttattttaatattcaaaaaattaatataaaattatattttttgaaaaaacaaacactaaaaataaaaaaccatcataatgttttaatttggaaaaaaattaaaaaagatattaaaaataattttggcattaattcaaattttagaaataaaactttagaggaaaaattagcattttttgaacaagttggtgagaaaaaaagatatgcaaatcaaaaactaaattctttaggttattatgatctaaaaaataatcgaaacacctttagacagcaatttatcgagcaacatttacaatttaaaagtctaaaatcagaaattattagtaattttagaatagaaaaaaaacaaaaatctgaaaaaaacaaggaaaaaaaataatgactatagatacaattatccccattttaacgctcttttttctatttttttcaataataactaccggctcaattgctggattatatagtgaaaaagcaggaattgtcaatattgcaattaacggaattatgattattggagcaacaacttatggtcttttttcaattttaatcgggattccaaatatggcaatgcaattattactgattccacttgctgcacttttttcggggctttttgcactcttacatgggtttatcacaataaaattaaagggaaatcatataatttctggggtagcccttaatattctagcaccagcagtctcctttgttttattaaaaatttatggtaaaagtaaccgttttgaatcagttgtaaacgaacttgcttttggacagaacaaggaatttcttaatattttttcacttaaattatttattttaattggtataattgttatcacctgatttattttttcaaaaacaaaattaggactacggatttccgctgttggtgaaaatccacatgccgcagccgctgcaggaattaatgttgataaacttaaatgattaggagtttttctatcaggaataatcggcggaattgcgggggctttttatttccagtatgccggatcaacttttcggggaaatgttcaaggtttgggatttttatcactaacaattttgattatgggccgctgaaaaattatatttattgtaatttcagggctgattttcccatttttatacactttatcaataaatttagccggaaatttcgggaatttcctcccaattgttgaagctgcgccatatctttttacaatcattttacttgctctaagttcgaaaaaagatttagccccaaaagcacttggaattccttatgataaatcactaaaataaatacacgaagaaaaaaatctaatgaaaagggacctaatttaggtttaagagttattttatgtacaaaaaattttttgatggggtcattgaagtaattacagggccaatgttttcagggaaatctgatgagttaattaaaaggataaaaattctaacttatgccgatattaaaactttagtgataaaaccttcagttgattaccgtttttcccagtgcgaaatcgtctcgcggtcaggtttgaaaattcccacttttttggccagaacaacacaagaaatccgggatttatttacaagagataactaccaggcaatcgcaattgatgaaatccaattttttgacgaggaaattgtaacttttttagaacaaatcgccgataaaggaattcgggtaattgtcagtggccttgaccaagattttcgccgcaagccttttggtagtttaccaaatttaatggcaatcgccgaaaatgttactaaattacaagcagtttgctcactttgtaaacgcgctgcaacaacaaccgcgcgtaaagttcttaatgaggcacaaactttaattggtgatcaagacgaatacgaagcgcggtgccgtgcttgtcatagtttataatttttttttttttttttttttttttttttttttttagtttttccccgcgtaattatggtataattattttttgcatacgcaagtgtagtttaatggtagaacttcagccttccaagctgactgtgagggttcgattcccttcacttgctccatatctttttgaccacttaatccttttttgaaaaaatatattgaattattttttcaaaaaaggatttatttaatatttttaaatacaaaggagaagaatggtatcattttctgcagttgtaattgataaattaggtttccatgcccgcccagcttcaaaagttgccaaattagcaagtgagtttaaatctgaagttaaaatttttaatggtgaaaaatcagggaatgcaaagtcaattatgaacataatggcattaggaattaaatctggaactgaatttcgcattgaaattaccggtgaagatgaaaatgaagcagttaaagcaattaaaaatttaataattgaagaaaaactaattcttgagtagctaaaataaataaattttttcttaattcttccaaaaaaaacccgtaataaatgacgggttttttctttttctccataatcttttattattaattatggagaaaaagaaaaaaattataaaaaaatataatttttaaactaaacaacaaaaaaattaaaaaataatgtaaaatttaaggaaataagtttattacttatgcttaaatttaggaggaaaaatgggtttttgttttaaaggtttatttagtagaacaacaaagaaatgttgtaaaaattgtaaatgcaaacaaaataacaactgtaaatgcgaatatgaagcttgtgaatacaatacagctgagcaaatttttgctccttcaacaggaaaattgattaaactttctagggtaaaagatggtatattttctaaggaaatgctagggaaaggattcgcagtccaggtaggaaataccggaaaaaaggacatttttgctccaatttctggaaaagttaatatggtttttcccacaaaacatgcccttggctttgcatctttagataataagacacaaattcttctacatcttggaatcgatacagttgaacttgaaggaaaaggaattgaaatttttgttaaacttaatcaaaaaattcaagctggcgataagattgccgctgttaatcttgattatctaattaaatcaggaattactaacactgatattattgttattgtccttaatgaatcagaatacaacaactttaaatttctaacttctccacagcgagaaatcgacactattccatttttagttggaacaagtagtaaatcctaagaacaatttgatttatgccttttatttcttaagtatggctaattatacactaatttttttattccaaacttttttttttttttttttttacggaaaagaacaataattatgaaaaaaataagaactaaaattttaacttagaaataaaaaacactataaatttatagtgttttttataaaaatatagttataattggttttaaaattttttattattttttaaatatagtgctagaaatttaaaatttattttaaaaagttaaaaatacttataaggcaaaaaataaaaattatcacataaattcaaagacattttgatattattagattattttcagtcgccaaaaacatcaactttgttgatatcgccaaaaccattaggaaataaataagtttttatatttttccctttataaagttgttgcatcgcttggaagtaagattttctttgatgctttgaaccataaattaggtcgtattttggtaaagaatatttaccatagtaaccattataatcatatccatatgatcttaaatttaaagttaaagcagttgaagcaagtctgtcgtttgcaaaaacaagtgaataaagtttatcatctttataaacaccagttcctgacataccggctcctgcggtaaaattatccagcaaggttcctaaacctcaaaataaataaggggtttccttgaaagttcgcgagtgctgatcgtatttagttaccttgataaaacctgaagaaacataagcgtttgagataaaaagatctgttagtccgggcttatttataaaagatcgataagatcttgaccaagaaagatcgccgccatctttaagtttgggatttgataaatccctgttaaaataaagttcatgatccttgttaacatggggtgaaaggctatattttcgcgtatctcaggcttgtttattttgatattcgtttaaagttgaattaagttcgccttctgagactggaaatccgagaccgtaaaactgatttggagctaatttttcatattcttgttcatttaaaaggttagtatccgagataattgtgctttgtttttgattattttttgcatcttggtgctccttatatcaatcccctgttatcagttttgcttgatcttcattatcaaaagttagttccataattgcaaaatcaagtatttcttccatatttttatatttttcttgctcagtgaagtccccaggttttttttcgaatacattagtcccaaaaaccactgtttttacgttaagttcagcattttttggtacttcttgattattatttagtttatcactatagatttggtagttattactttgatctaattgttttccggcattatgaagattacttgattttgttcgcaccgaaattcttatagtatcataataagcatcgcgacgactttcaccagttgttggcattatattattgaggtcaacatcattttttatcttggttagtacaagcgatcaagtattatattgtcgattataagaattataagcatcttcatcacggccataaattgaatcaggatgatagtcatttgcgactaaaagtcggtttaaaacatgagcatttgtgataaaatatcaagtaagcggatatttttggccatcctcttttttgtaatcgagaatattcattgtcccatggaaacctttagaaaaatggacaatttcttttggatctaaatattcaggttcaccttggccgccatcaggacgaaattttagaaaatctccattgacaatttcaacaccaattgaattttttgttaaatttttatattcttgatttggtaaaatccggggaaggccgactcttccaggtccacctcttagtagttggccagttgcctcatcgacatgaagtgccggggatgtatctcctttttgatgttctggaatctcgatactagtaattttaccagaagaatcaaattttgggacaacaaaagttcgataagcggcattatcatataaaggttggccggcctttttagcttcttgattaagttgtgattttagattttcgggtaatttttttgtttttccataagggtattcaactaagccatctgggttttcaagaccgacgattctagccgggccgccgccaaatttttgaataaaatacttatattcatgatcggggaaatcatatttatattgatcagcaacaattcgtttgccgtctttgataatcgctcaattttggcctttaggtgtaatttcctttaatttttcataatattgattaactttatcagctggaatttcttgttttggttgctcaggtacctcctgttttttctcaataggttttaaaatatcattaaaagaaccaataattaactttgttaaatgatcaatttgataattttgtttttcaagttgataatctaaagatttttttgtattatcccagtctctctgtttgttttcaagatcaggatttttgaataatttttcaagatcagctctaatttcatcaagttttttaccaaaattatgataagcttgcttagaaggcaagttttcaaaattttggtattcggaatttagtcgcgcttttagttcatctctaattttttcaatatctttttgatctgtctttggatttgttttctggtttgttgttgatagattttccttgcttgtttgtttagaacaagatcaagatattagtgaaaaagtagtaaaaacaagcccaaaaagtaagaaaaactgcttgtttttcatagaaaagtattttttttgcataatttaccccaaaaaatttaaactagttaacaaggtccgaatctgaagattctgctacttgttttcctacaaaaacttgagcagtcccaattgttgggccaactttattcttaatttcctcgctttcaacataaatctgggaaattccattccctgaaccattagcaacttcgataaatttttgcagctgcgaaattgcatcaccttcgggactaccagaaatataaacgggatagccataaattgattggccatttacttttacaacgacttttggactctcaaagccgctggcaaatctctcggtaaattgggcaccatttagatcagaaaatttgaaatttagacgtttagagccagaattttgcccttttataatcagtttcttgaattttagctgcctaaatccagtataattttcttcagcatatggatcatcttttcaagttctaactttatcattaaaacttttatcaagttcatcaaatttaattcctttaaaagtatttacatcagtttcagaaaaatcaagtgtagtaggccatccaccttttccaccgtgggccccttgaaaaactctttgttcaatttttgaatcaaaaactatttttagaccatcattaatcttgtcaatattatcatttttttctcatcttagcccatcaaaaataattgaaccgccaattttgccctgatttgagccataagatgcttgattattatagtcaaaactaataaaatcaacatttttcagcgcatttgggttgatttgccagtcatcatctagtgaatttttttctgtataaattgataattcttttaattttttattctcaagtccacgaagcgatcgagttgcgccggtattatttagaaaaactgataaagtttttatttgctcagggattgccttgaaaatttcttcggcattctggagcgaatgcgtttcaccgatatttttgattcttaaagcttgaactttgctatctttttgggagatttttgccattatctccttaaatttatcaaaagccttattatcatttgcatcaagttcaattaattttaaaggttgttttttacttttttcctcattttcatcatttggactatattcataaaccttaattgaatttgtatattcactgccaatttcagaactaaattctgagcttttattagttcttgtccaacctggaaaatttccattcgagatatcataaggtgaaagccctcaatatccgggagtattaaaagttcggctttgattatgttttttcatcctgttaattacaggattttttgattcatcttcatattctcagacattcgtggattctgttgatggcaaaagtccttgacgaagtcattttaattcatcgggactaaaggatgttttttctggccgtgattttagctgctgaagatactgtttttcgcgattaagattatattttggcaggtcaatatggcgctcgtaagcttcttttcatagttgtcttcctgctggtgaattaggaattttcccccttacccagtctttgtcaaaatcttcacggtaacggcgttcaatttcttgaacttgcgcttccaaacggctaacactttcttcatatttttttatctcagcttgaagaccttgcttataacggtttaacgctttttcgattaaagaataatcgagcgatccatagtcgtcctttttttcttcagtttttttgggaatttcacttataattggcgcttcaattttctccttaggtattattgccggaggaggcggagttggttctacttttttaggtgttatggttataattggttttatttcctcttttttttcttcaggaggtttgattagctcgactttttgtacttgttttttaagtggtttaaactcagaatttgttacaggggaataaaaacttagatcatttggatcgtttttagcaacacttgagggagctttggaattataactaatctgtgaattaaagcgaaaaaaattactaaactgcggattcgcaaaaaaactcattccggctgcaattacagcaactgtaagtccactcagaacaattttctttcttttcgataaataaaacagcataattttctcctttttttcttagttaatttgactataaaatcctaattatacttaatttagtattttaccacctttttttttttttttttttgcggaaatttaaaaaattttttcaaaaaaaactatgaattaaaagatttttggtctttaaaaccgaaaattaagtaaaaaaaataccttataataattagaaagccaaatttttggtattataagaagactttaaacttataaaattaaaaaattagatgaaaatgatgctagaatcacaaaattatttattatttttaaccttgtataaattgataatttggaagtcaaaaattcttcaattatgaacccaatacttgttgaggattcaatagaattattttcatcttcaagtaaattataatcttctaattttaaagttaattcatttccataaaccttaaagatttgtttggtataatcctcaatttgcttctggaaaaatttaaaaccttataatacatctttcttatccagagattttttaatagccaggccgatagcctttgctaaaagtgggggcaccgcatttccaatttgcacaagttgtcattttttttgaccctttaaaaataaaactatcaggaaatgactgtaagtcagccaactcacgcggagttaaaacccttggaagtttaggatggagattcaccccgccatgattttttttaactgtacaactaggctgatctcaaggtgatttcttccaaccatcagagtaatttttataaacgctttggccttcggatgtctttaaaattttttccctcattttagctgaatgttttgtaaaaatatgattaatttcaatattttcttctcaattcatatatttttcaatacactgacctaaagttttataattttctgggctaagaatagctgcagggaaaaaatttgtcaaaccaatccggtttgcaataaaaattacccgttttcttatttgagcgactccaaaatcggcactatttaatgttgctacattaatcttatagccgattttttcaaaatcttttatgattttgacctcaatttgaccagaaagcatggttctaagtccttgaacattctccattaacacgaattttggctttaaattcgcaacaatatctaacatttcaaggtataaattatttcggggatcatcaaagacgcgattacctgccatcgaaaagccctgacaaggaaaacctccagcaattaaatctagttcttgatccttgaaatgatcataaaattcggattttattttagaatctctaatatcgcttagcttaaaaagttctttattttttgacctttttttaaaattataggcataggtttcaacggcttgtttcattatttctaaacttgccaagggcaaaaatcccgccataacaagaccacaagaaaggccgccagcacccgaaaaaagatcgataaaattataaccattgtgataacttgagctccagccatcaagtttcttcatttcttcatttcttctgagatctcaataaagtggactttttctttagtttttcctaaatttttccttagtttttcttgttttctataggatgattttcatttttgataatcaaattccgaaactagatacttattatttttctttattgagattaaagtttttcttgcaatttctcttctaatgaatttttgactaacagcttcaaggtctacaatttcggaaattttatagtatttcatttctagtctattatatattaattttttttaaatttttttatcaaaaaaaggaaaaatttagttaatttcaccagattttcaccgatctggtctctagatcaagaattttaaaacttataagaactgaatttcttgaaaattcagttaatttatcagcccattcgattgcaacaaaattatcttcaaaataatcataaaactcatcgagttgaccgggaaaattatcaagatcaatatgaactaaattttcatataaaaacataaaattaaaagaaggggatataattttagtttttatcccgatttttttggcaaatttttttacaaaatcggtctttccagagccataatcaccgactaaataaataaattgtactttattttcaagtatttttttaaaaataatctccaaatcaactatagatttggagattatttcttttgaaaaaatataattttttcttatttcttcatagtccataaattactaacggttattcttcataaagaaactaagtggattacggatatcaaatttggactttggttcataatttgaattagttccagctggaattttatgcccgacaataatattttctttaagcccttcaagtttatcgatctgggaagaaattactgaatgaacaagtatttttgaggtttcctgataactcgcggcggctaaaaatgaatttgaaagaagaggaatttgttttgctccttttactattacattcccaaaagccggatttttattctgggagatcagttgaccattaacttcctgataatcgctaatatcaacaatcgatccgataaagaaattagaatcaccgttttcaatgatctgaacttttgaaagcatctgcctgattatgatctcaatgtatttatctgaaatcgaaattccttgcattcgataaattctttgaatttcttttaataggtaattttgtagtgttctagcatcagagacagctagtaattcttttagaataattggtccttcgaccaatttttgtcccggaatgactttatctccgacttttacacgtaatttttgactttgctcaatacgtataatatgttcagctttttcatttttgcttgttttgtactcgatagtaattaaaaatcctttatttgccgcatttttttcggcaagatcagaaattttggttataataccataataaggcgaaatttttgctggcttacctcaaggatgctcatgcgagtcaattaattcaattaaacgggtaaatccccctgtaatatcttcaacattagcaaccccaccggtatggaaagtacgcattgttaactgcgttccaggttctccgatcgattgagcagcgataattcctacggcttcaccaattgaaacaagtcgatttgttgctaaatctttcccataacattttttgcagacactatttttgatatggcaggataaaattgaacgaatctcgacttttttaattccggcagcaacaattttttttgctgtttgtaaatcaaccatggtgcccgcacttgctaatttaattccccgggagtcatagacatctttatttaaaaagcgaccttcgattctttctagtaaaggaacaattatcgtatttgttttagtatcaattatatctttgacgacaaagccaaaatcagaaaaacaatcttcggcaacaacgacaatattttgggcaacatcgacgagccgacgagttaaatatcccgattttgccgtattaagtgccgtatctgtaagtccttttctagccccatgggttgaagaataaaattcaaaagaggtaagaccttcaaggaaagatgacttaactggaacttcaacaattgaacgaactaccctttcattttcagcatcaactttaagagctttaacattatttgccatcaaacctcgcattcctgcaagttggacaaagttagaaatattaccacgagcccctgatttcatcatcattacaagtgaattttgattatcatctttaattgactgatttaaatcttcttggatatcatttttgatctgcgttcatttagcgattgctaaaacatatctttcatcatcggtgattaaaccttttgcataaaaagtgtttaatttattaatataattttcaccttctttgataaattcatgtttttttggcgccattttgatatctgaaatcgcaattgaagttcccgaaagagttgaataatgaaatcctaaatccttaattttatcaagaattgaacaaaccatgttattgtatttgaaccaaattttttctaaaagttcagctttttcgtgatcttctaggacacgataagactcaactggaccattttgttgaagttgtttatataactgtgaatattcaaaaattgtaaattcacttaattttgaaagatggggaactggtaatttttgttttttatagtcacgtaatttttcatagcgtaaaacgcaattttgataattgccaaaatcaagttgatcaattacagttgcaatatcttcttttgctaaaagaccatcataagtatcaaaaatttggcggacaatcttggcaatcgcttttttatttaaaggttcattaacctttaaattttggatatactcgcgaaaatttgttccataaggaaggacatattttttgatctgactaggataatttagttctaattcatcaacattatcatcaaaaataaaaggaaaatttgccgggaaaatgttattaagaataaattttcccaccgttgaaattaaatgtccgcgcatagttttggcaataaaaggttttacctgctcaaaaggtaaaacaacccgggcatgaagctcaacacttcggaattcatatgcttttagcatcgcttcataagttgaaaagaaagatccttccccttttgctccggctttttcctgagataaataataaagtccgagcaccatatcctgagaaggattaacaattggttctccgtcttttgggcctaaaatgttcttatctgcaaacattaattcctgagtttcacggatagcttcaggagaaattggaatatgaacagccatttgatcaccatcaaaatcggcattaaatccggcggttacaagcggatgtaattgaatcgctttggctctgactaaaacaggttcaaaagcttgaattgaaaggcggtgcaaagttggagcccgatttaaaattattggtttattttggatgactttggcaacatgaggtcaaataattgggttttcttcttcaatcattttccttgccattttgattgagcctacttttttttcctgaattaaattgcgaataattcagggttcaaaaagaacagcagccattttccggggaagcccggcttgatgcatttttaatttcgggccaacaacaattactgatcttccagaataatcaaccctttttcctaaaagattttggcgaaatcttcctttttttccagttaaagcatcagaaattgacttaagcggacggccttctttggttgttacttgatttgttgattttttttgattatcaattaaagcatcaacggcttcttggagcatccgcatttcattttggataataataacaggagcatgagcggcttttcatctttttagacggttatttcgaataatgattctgcggtataattcattgcaatcacttgttgaatgacgggagccatctagttgaaccaacggacgtaaatcagctggaattaccggaagattgcgaattatcatcatttttggatcttgaccagagttaataaaagcattaattacttgcagtcttttataaagtttatctcttttttgatttttaagaataattttcttatttttataaatttgtttctgaaccccggcaagttcagcttcaactgccgctttttcagctctaagatcaattttatcaagcaaatattcaatcgcgagcgctcctgttgcaattcgagcacttgaaaattcttcaattatttcattaagttcataataatcaaccccatattcgcggccgattttacttgaagttacatcagctaattcagaaattgactctgctaaggcattatgttcctcgcttccaggaggataaaattcaattatttcaattaaggcgtttttataaattaagccggcttcggaaatgtcaatgattttgttttgttctaaggatttaagtcccccagtttcaaggacaatatgtgatttataataaattagattttcaattgcggctttagtaattgtggtaggaactttagaattaccctcaaaaactttaaggccaagtaatttagcaataattgaatggtcgattttaaaaaatcaaaaatgtaaaatcggcgcatttaaagcaatatgacccattgaataacgccgggccatttttgataaaattcgtgatccacgaattttacattcttttgtagcgatgcatagctgattctcgtttgatttccgatatttccttccacaaactgaacatttataatcaacaaggggaccaaaaattaactcatcaaaaagaccgccgcgctcgggcttaaaagttttataattaatcgtttcgggacgatgaacctctccccttgatcattcaaggacatcctcaggagttgctaaagcaagggaaattttctgaattgaattctcggaaatctttgcatattggcgcgaaacttttgtattcattttttaaattctcctttaaaaataagagtatttttttattttggctataaaagttattatctagtcaacttgtcaaagtcgatattttcttcatcaaaatcagcaaattcttctagcttatttagttcaatccggccatcttgattatattcgtcaatgaaattagatggaatttcgggtaattctaaaggatcttttatttcttcaacttcttgattttcttgatcatttttatgaacttctaatttaatcaaaagtccacgaagttcataggctaaaacattaaatgattctggggttcccggactaggaatttttccccctgaaattatattattataaagtaaatttcgtccttgaatattatcagatttataagttaaaagctcagaaagaacggaagttgccccaaaagattcaagtgctcaagtctccatttcaccaaatctttgacctccattttgggattttccccctaaaggttgctgggttgtaagtgaataagggccaattgatcttgcatgcattttatcatcgaccatatgtagtaattttagcatatacatataaccaacagaaacaggattttcaaagggttggccactaattccatcaaataatttgaattttcctgactcaggaatatttgcctcatcaaataattttttgatggtctcaattttgatcccatcaaaaaccggagtgacaaattttgtttttaattttttggcaaccatccctaaatgaagctctaaaacctgaccgatattcatccgcgaaggtaccccttgcgggtttaggacaatatcaaccggagttccatcttctaaaaacggcatatcttcaactggaagaattacagaaacaacccctttatttccgtgtcttccggccattttatccccgactttaatttttcttttttgggcaatcaagatttttattagcatcccaacgccttcttcgagattatctccttgatcacgggaaagaatctggacatctattacagttccgccctcgccgtttttaacccggagggaagtatctttttgggcaagcgcttttttccctcagattgctgccattaatttttcttcagcggtgggattatcttcaccttttggagaagttcggccaactaaaatatcgccagtatcaacttctgaaccaacaattacaattccatttgcatctaaatgaagacgagatttagccgatgcattgggaatctcggcggtaagaatatcatttccggctttcgttgaacgaaatttaattgtttgctcttgaatgtgaattgaggtaaaaacatcgtcttttacgagcttttcgctaattataattgcatcttcataattataaccatatcaagtactaaaagcgacaagaacatttttacctagggcaagttcgccattatccgttgaaggaccatcgcagatcaactgcccttttttgactttatcaccaactttaacggttggtttttgtaaaattaaggtttcttgattggatttttcaaaataacggaggtaatgaatctccggtttttcgccatcatcaatgatgattttttttgcatcaacataagtaacttttccgctaatagacgcgcggagatttgttgctgaaaaacgggcaacagcttcttcaattccggtagcaacaagtggggcttctgatttaattaacggcaccgcctggcgctgcatattagaacccattaacgctctatttgcatcattattttctaaaaagggaattgcggaagcagaaattgatgtcatctgcattgaagaaacatcaatgtaattgacttgttcggcatcaaggacaagataagtttgattttttctaactgttaatttatcagggataattcgattattttgatcgatttcaactcctgattgtgcaaaacttttatcaaattcttccgatgcggctagccagtgaacctttgaatagtcaacaatgcgattttttacttgataataaggggtgataataaaaccatattgattaattcgcgaaaaaactgaaaaattaagaattagacctatattttgcccctcgggagtctcaactggacaaattctaccataatgggttgtatgaacatcccggacttcaaattgagcagtatcacgatttagaccgccagggccaagtgaggtaacttttcttttacttgccatttccccaagcgggttaatttggtccataaactgcgaaagttttgaggagttgaaaaaatttttaaattgattataaattggcttattattaataattgattttactgttaactgcgaaagatccgattttgttgaaattttttccttagaattcttttcaatttttgtaagtgcaatcaaaaattgattttgtaaaagttcgccaacactaactatccgtttattaacaagcgaatctggatcatcacttttccctaaattacttaataaattaaaataataagaaacaattgcaataatatctgataaaactaaggttttttcattcaaatttggatcagttgcaataacatttacaggctcactttcttgtaacattgattttttatttggtcaaactttaacaattgctacataaaagcgtttccataaattttcattacgggtaatttcaagttgccgggcataaattgttgaatcaactccttcaatttcggaaagaggaatttcttcattgttaaatttttcttgaatttctaaggctaactgccttgtgatataagtcccttttttaaataaaattttatttttttttgatactaaatcttcggcaaggtaagtctgggaaattcgctcgaccaagtttagcttggcattgagcataaaacggcctgttgaagctaaattataacgtctttcattaaaaattattgaaggaataagattttttagaccttcttcggtgatccgatcatcttttctgactattcgataaattagctctaaattttcttcaagtgattctagtttatgtcttctgattgattcaagaagttcaggggaatttccaaaatattttcttactgtctcatttgtaaaaccgattgcacgtaaaaatgataataatggaatatttttatgtttatcgattctgaatttaacagtatcgacttgatttccagtaactttatggaaaatttccattcaagaaccaagttggggaataatttctaccttattaaaaaggtcatctgcttgttgatttctaacattctcacgaaaacaaactcctggagaacgaattagttgagaaacaacaactttttcaaaaccattgattatgaaagttccgccctgagtcataaacgggaattctgctagtaaaatttcctgttcttccatttccccatcttcggaatgaactttgacaagggttacataaactctggcagaataagttttacctttaatttttgcctcgcggatcgctaaatattcattttcaggtttttctacccgaagtgaaccgcggcgaaaacttatttctaattttccatttgctgaaacaattggaaaaattcgatcaaaagcttcgggaatccccacatgcaaaaatcaatcaaaagattcacgcaccggatctagaaaatccggagtttctaaggttttattcgcaaccccataaaagcgacgatcagtgccaattccataggattttaatttatatatgtgattcatttttcccttcttaccattttttcaataagtttttaaattatattagaaacgtaaaaaaataaaaatgtttttataatttaatccaaaaaaattaaagaaaaattttattgggatatttttttatagaaaaataaaaaaataaaaaaataaacaaaaacggtgtttaaaacacctttttgaattttaattaagaactaatttttctaagaaaaaattagtcaatcgaaacttctgctcccgctgcgactaattttgctttatattcttcagcttcttcaggttttattgcctctttgagaactgaaggggctgcatcaacaagtttttttgcatccattagacttagacctaaaagatcttttactactttaattacagcaactttttgttgtccggcagctttgagtgttaattttacttcggtttttacctcttcggtagcaactggagttgcagctactgcaactgctgatggatcaactccaaattcttctttaagtgcatcaacaaattccattacttctttaatggtcatttcttttaatgattcaataaattgttcttttgtaattttagccattttttccctttctaggcagttattttttgttcatcgattaataatttaagtccaaaagcgagttgttttaatggactttgaagaccagaagctaacattgttagtgcttctgtataacttggaagcgcggaaattaatgcattttctgcggcgctgacaacttgattgtcataaattccaccttttagaattaaaagtggttgttctttggcatttttagcaattatttttgctggggctattgcatctgttgttccaaaagcgaataaatttggaccaactaaatcagtttgtaaatctaaataaccgttgttttcagcagctattttaaaaagccgatttttataaacttttgaaagaacgcccgcggatttaaattctttacgtaattgttctaattcattaacagtcagtccgcggtattcaacgattgccaatgatgaagaattttttaataaactatcaatttcagcgacaatttcaacttttcttttacgaaaactattcaattttgctctcctttctttaaaaaaataaggggcaatactgaaagatacattcaaataacaaattaagccacaccggcagttattatctctatgtattgcgtttttgaattataccagaaagcgaaaataaaaaaagtttttttttttttttttttgcttttttttttttttttttttacaggtaaaatttatttattcttaatttaaagtagaaatttttttatttatattatataataagtagtttaaatgaaaagcaacttatccaaatagcaaaaatttttgtttctggttaagttaaaaaatctcaattataccataaaaaatttaaaaattaaaaaaatttttatgaatctgtggtagaattatatctcaatatataatataaataaggaaaattaagcggctgacagaaaaaaaggagaaaattatgctgttttatttatcgaaaagaaaaaaaattgtccttaccggacttacagttgctgtaattgcagccggaatgagtttttttgctaatccccagtttagtaatttttttcgctttaattcacagattagttataattccaaagctccttcaagtgttgctaaaaacgatccaaatgatctaagtttttattcccctgtaacaaattcagaatttgacccgcttaaaaaaagtcagccaaaagcggatctaatcaaacctcttgaagaaaaaaaagaggacataaaaccacaacaaatccaaaaagaagaaataaaaccagaagctgaaaaagaaagttttgatctaattactaccccaaaaacgcaaacaagccaaaatccagaacagacccaaactgagacaccaaaacgtgttgatgccgaatatggatatgtcacccttgattgatcaggcctaaaagttaaagcttatgtcaagaaaaaaccaaatcgccagtattcaacttatgatgtccaaaatggcttagctaatcgcaaaccttaccaggcccaagttgttgatgaagttctaagtattgaagttacccctgaaattcgggaagcaaacagaaaaaatgcagcccaggctcttaaaaattccgttcaaggctcagcttttagtatttatgctgatacaatcgctcaaggcgatgataaagttgctgcagttgttgcccaaaattatgaaaattattataaaaatatgtttttaaaatggcgggaattatttgaaaatggcgataaagtaagagattttctaacccaagaaggttataataaatatccggatatcaaaagcaaatatgaatctgatcttgccaaagccgaaattgaaatccgtaaagctgaagcagaagtccaaaaaatctataatgaaagacccccaagaactggatttgatggctcaggaaaagaaacttttaccgaagaaaataaaataaaactacgtgattgacaattaaaatataatgaggcaatcaaaaaacaagaagcagcaaaacaattaaaagaagatgcaaaaaatactaaatatgccaagttaatttattatcttgattattctaaatttgttaaaaattcaaaagaaaatgatgactatctttcaaaaggatttacaatcaatccggataattccaatatttccgttgatgctgaaggtacactaaggtcaaattcttgatcacctttgattaatcaagtaacttcagtctataaaaaagataatgaaaccagacgagcttttggttatggaagttattgatgaagatctgggggccaaattcttgatggaacttatgaaggatgaactaaaaaagatattacttcttcgcaagaatatgcaaaatattctgtatctaaatcagatggaatcgaaattgccgagctgaccaaaaatacagataatactgcccaaactgctcgcgataaagggatagtaatcacaattgatttttcaaatgaatcagggtataaaaaaacaaaaaaactaatcgaagatcttaaaaaagatggaaaacaaatcacctcttatcgtttttttcatattggaaaaaacgatgcaaaccagaaattcaaggatattctagaaactctcccagaaaatttaccccaacttgaacttttatttgataatacaaatacctccgcccttttagctttagaaaataaaaaaattgatgaactttcaatttataccgaaggaaattcactttctgatgactgagcaattaatccttgagccctaaaaaacacggcctgatataatacaaacgattataatgttagttttgattatgctccaggagctaaagttgcaactagaattacttttaattcattagcttttgatgatagtgactatcaaggaaatggggattataaaaggataaatgatggtctaagaatggcttactgaactagaaataatgaaaaagttttccaaggtagctggggtcctggcctaagtccggatattaaagaatccgagaattcttatccaaccggacttgatcttacaagggtcaaaaaaatgaaatcacttaaaggtctaattttctctgatcagcaaaaatctacaaattcaaaaccaagaagactaactcgaattggcctttataatgactcagaaaattttgaaattccagttgatgaactaaatcatgcccagtttgatgtccttgatacccacccgatgatgcgaccaaaaccaaaaattttctttgcaaataattcagcaacaaaacggattaaagttacaggaaatgggactctaacttctcaaggggcaactaatctccgcattcttttagaaaatggtcgacaaaaacatgatgatacaaaaatttttactgatcaaagaataattgtcgaccctaacaattctgcgcttgctgcttcgcttagttcagccggatttcaagttgatcagtcagcaacttcgcagattaaatttaattaattaggtaataattatgaaaaagaaggcaaattttaaacttttactaacaaaaaactggataattcctagtattttttcattcccttttttgatctcagctgcttgttctagccaaaaacaacaagaaaataaggattctttagatcaaaacggtcaagatttagacaaaaaagagcaaaaacctgcaccttcaattctaaaagatcaagaaatctccaaggaaaatttagataaactaccaattattctaaaaaaaattgatgggtctactaattttgaaaatttaaccattgaatcagttggtaatgatttttccagacttgaatttgaaactccaaatgaagatgatcaaaaattaattgatattaaagttttaaataaaaaatatcttaatagtgattttgaaactagtttaaatgaaggggccctaatttttaatctaaaaatttcttcaaagaaaaatcctgaaattgtccttgaaaaggatgtgccaatttcaggatttcgaaaatcacgaagtagtgaaattaactttaattatggcaaacgttttgcacctgattctgataatgaatgaagtcaatattttgccaaaaataattatcaaagatatacatatgatgcaaaaaaatacatggaaactcttgaaaaacaactcgcatatatctctggattaccttattttgatattaaatcttggcgccctgaagtaaaaagaaatcaagaacaaattaataaatataatgaaaaagcaaaagaacttaaacttgatagctacgaagatgccctaaaaaaaggctttacaatgccagtctatgatgctaatggtaatgttgaaggtcttaaacttttagatcgcgatgaaattcctaaagggccagcctgatgagatctaatcaaccgaaatgagaatcaagcaagcggacttgcccgctatatcccaaatgaaaaatataaaaaagcagccctacaaacttattcagtttattttgcttggccagcaacaattgatgatgttggagctgaatatataaaaccttttcttgaagggcaaagaattggggctaacccgatgcagcaaacaagccggggaacaatgtgaattcttgattttgcccctccaactgattcaagtcagcaaccaactaaatgatattttggaacaaataatcacgtagttgaatcttataaaaaaaatgcaagtcattttagcatgactattttaaaaccggaagttggaattagaacaaaactaaaaactgcaaaaggggcaagtgatgaatcttatttaacagctagtttttcccgagaaaatttagagcaaaatgctaaaactgataatcctcaaaataaaactgctgagtatatctcccctgatggttatggaattcctggaattagaatcatctatcgagcaaccgattttatgacaacttcgccaaaagattttttatcagaagctgataaaaaaaatgaaaaatataaggatattgaagaatttgctgattttgctgtccttgaagttgatttttccaaattcaaagttcccgatcaatattcttcccgtaatgactttatcaaagcaatcaccaatgactattataataaaaaagaagatcatatcaaattcttaaaaacttcctatcttaaaaattatgaaaaagcggatacaaaattagcaacaactgataattccaaaaaagaaaatactgaccaactttttattgtcggatacccgcaggcaactggtgattttttccttgataaatatcaggattcctatgattataatcactcaaaaatcggatattctctctgaatgaattctgagtcttctttttataataatttagccagcgatgagaataatcctgaatcaaaatcgcaagataatgcaaataaaggaaattatttttctttaaatattggttatcgtagttttgctgataaacctggacttgctgatggttttattacagtcccaaaggttggcaaagaacttagtaaatcgacaattatggctgatcctgtccataaaaaacaggtaaaaaaagaagtaatcgaaaacgggaaaaaaataatcaaagaccttggcgaactcgatgttttaaatcaaaaagcttatcttggttatggactttattatattcctagacattttgctccacatgggggggcctcaggatcgtctattcggaatcaaaataatgaacttgtcggtatttattttgtttcaaatcagacggcaaaaacagggcttgcggtcgcttttagatcggaaggatttgactataagggtttatatggaaaatataatcttccccaatatgatttaatttatggcggaggtaaggatcaaaaaacttcgtttcgacaagctcttgaaactatttatggtagcgaatttaaaacaaatttatttaaaaacggggtaaaagaaattccggccgattataaatttaataattcaaattcaaatacacaaaaataagcccgaataattaaactaaaacaaaaatttaaagcttattttgttttgctatctctgattttagaaataattcaaatgtaaataagttaaaaagaaaatgattatggaaaaaacttcgtaatttttctttctctaaacgaagtcctgtaccatcagttattcaaataaattcaaaattaaatttttttgctttttctgctaaagctttaaatctttcaatttccgaattaaattttgacccagaagaattaaaaaaatttgtctcaactacaaaaactttttgatttagcataaaaacaaaatcaaaaagtttttttaattcggttattttttcctgctttttataagtaatttggtatttttttaataaattttccacttgaaattccataaatttaccacttttattttttttatcattacttgataaccctacttcgattccaaataaataattagaaattgatttgatttccggatttataaatatttgattgaccaaacctgttaggtttagaaattcgtataaagaattaaaattatctcattgaaattttttttcattaaaagcatcatctatataaaaaaatgaagaatttttttgaacttttttagctagaaacaaaggcagatactgaaaaatagagacattttccttaaaaacacttcttagttttatattaaaatcaaaaatattatctgattttaatttctcaaatatctctaaatcttttaaagaaagacttattttattaattttatttcaggaaacataatcctttaaaatataagaagtatttcttagagacttaaaaaatacttcaaattcatagttaattaatgcgccgtcatctaccttataatttataataattacctcatttgcagccagaattctatcctggctattagaatttatgaatctgttaaccggtatttgaaaaatactaaattcttttaaattatttaaaactaaagaggtagaatgatttgtaaacattcacttaacttttttagcatttaatttttttaaagtatcaataagctccaatgtatcttgttttttccagccatttctatcataatttgtaaatgaattatcgttttctgaatcatacggagggtctataaaaacaaagtcattttcttttgctagcgataaaatttcaagataatttttattataaatttctatagaattttcatttaaaaatgaagaaatattatttaaatttttaaaatcaaatatagtagaatttataatttctgcattattaaaaggcacattaaattcgcctttggaattcacacggtataatccgttaaaacaggttttatttaaataaataaatctggctgctttttttatgctattttcaggaatttcagaccttaatttgtaaaaaaactccttagaatgaagacttttataaatttctaactgctttgttaaagtatctaaattaattttgatttgcttccaggaattaactaattcggaatttatatcattaacaatagcattttcaggttgtaattttaaaaataaagctccaccacctaaaaaaggctcgatatatgaattaaaatttttgggaagcaaagacaaaattacattaattaactgagttttcccaccaacccattttacaaaaggctttaattcagattttgacataaactaaattatataagcaaatagagataaaattatttaaaaaaacccagaaaaaaagaaaattttcataaattattccacgttttctgtaaataatttcattttttaaaaaatttttttagcaaatgaaattatttacatttatattaattttaagaagttgatagtaaatttttaaaaacagcatcagagtttccaaacaaaaaataagagtttttattatttaaagatgaaaattcaccactacttataaaataattatactttttttaaaaaaaagtataattataatgtttaatataaaaactgaaaggagaccaaattatggtgacaaatgaaaaaactgttattataataattataacaacaaacggcggaaaataaggttaattaataattcacacacacaatcacccttttgttgttcattataatttatatttattaattgctaaaaacaaataaatatataatttttcccaataaaagtcataaaatatgcaaattttaaaaaaaactaaattttcaaaacaactacaaacagaagaattttctaatataaaaattatataatttttatattagaaaatagtttcttaattttatttttatatttttatgaatttttttaaccttaatataaagaaaaataatgaaattatttcaaaatactattcaaattttaaaacaagataaaaaaaataatttcataatttttttactacaaattatttttttgactctcttaaatttacacttttattcctactcttttatccttggctttgtcaaaaaaaaggtgccaattcaagacaaaaattttattttgtgacttttaattagcagcctttcttttgttttttttattatttttaaacttatctatgtttatcactcaaataagaccacctttaaaatttttaaaaaaaacaccaatagattatcagaaaatataagaaaaaaaacatacgaagaaatattaaaaaataaggaaacttatatatctttttacaatctgaatttagatcttacaaattcgcttagtatgacaatttatagccatttatttaagggtgttatttatattatctccagcactatatttatttttttactaagcactaaatcttgaattttaattttacactcgacacttggtgccaccataagtgtgattttattatttaaattttcaccgttaattacaaaattacaaaataaaatccaacaactttttcaaagttatgccggaaaacaaattaaattattcgggttatttaatttgttttactttttcaataaaagaaatgtttttactaaatatcttaaatcacaattattggaaaaatattcccgcgaatttggtctactgaaaaattttcaatataaaacttttttacttaattccggttttttattttttgttcttagtaattctataactttgtcgattttaacatattataaaacattcgatgttaccttatttatttccttgtttagtatgaatttggtaatggtaacaggattttcaagttttttcacctatttattaacagcacaagcattaaatccatatgttaataaaattttcgagaaaatagatactaaaaatgaaaaaaaaatagttttgcaagaattaatttcagaaataaatttacaaaatttaaattttagttacagccccgaaacccgcgttttttcaaatttaaacctaagttttgaaaaaaacaaaaaatatgcgataatttcaccttcaggaaaagggaaatcatcacttttaaagttaatttccggagttttaactaattatgaaggtaaaattttaattaataattcaattgaatataaggaattagaaccaaaacagttaagaaaacatattgcactaacaacaaatgaaaacataattttcgaagacactttggcaaacaacataactttatgagataaaaatcccgatttagatttgctaaattctttaataaaaaagtataaaattgataatttttcaaaaccagaaactgaaattagctcaaaaaatttatctgagggcgaaaaacaaaaagttgcattggccagattagagtacaaaaatttagatatttgatgtttagatgaagctcttgataacattttcaaggaagatgcttttgaaatttacagtgatttactttcaaaaccgaataaaacaatttttatcgcaagtcaccacattcctgaaaaaataaaaccgatgtttgaccaaataattgaaatttaaggaggaatttatggtaaaatctacaaaacatttcaaatttatcctttgaaattgattatatttgatttttacgattttttttaaaatttatctcattgttgctccttattttatttttacttttattctaaatgaaaatttaacttttttttgggtagccacaacatcttttttaggggttagaatttttaatatctttttagattttatgaatcaagcatattttaaagggtttttgatctttcataagatgaaacttgccgaaaaaataacaaattttttggaaaaaacgacttacaaaaaatataacgaaaattcaagtgggttttactattcggaaattgaaaatacaatagaaaaaagcgtttcacaattttatgcaaatttattgtcctttttgcaaactctttccataattttgatgactttaggtttatttttttatataaactggattttagcgttaattattgtcggtgttataaccttttttgtaattacaacttctttactatctaaaaaattaaccaaacttcaatccgcaaaattgcaagcaatttcggattttaacaattctttaagcacttatcttttaactttgccgcaattaaaaaccttaaattctgatgataaattcgaatttataattaataaaagaaacaagaaaaattgaataactagagaaaaatatggtatattttccgacttaatttcattttttaatgaatattccaataattttttctccgcaataatcacaattggaattgcattttggacactttattataaaaataataatagctctgaaattgtttttgcaaatatatctttaattgttttagtgcaattatcgtttagtgagttttttgcaaatgcaaaaacactttttaataactacccagcaataatttcgggatgaaaaaatattaaaaattttgagcaaaaaaacaaacttaaagttgaaaatttagaagaaaatttacaaaatttagaaggagaaatttcttcaattttaattgagaatttaaacttttatctacccgatagaaaattgtttaataacctaacttttaaaattgaaaaagggaaaaaatacataattcaaggagtaaatggttctggaaaatctaccttagcccgaattttattaggagttgaaaaagaatttcaagggaaaataatagtgaataatcattttgatatcaaagatctttcccctttttctttaaataatcacattaattatgtctataataacccaggtattatttacggaactattttagaaaatatttcgctgctagagcctgaaaaaaataagaatccaaaagaaattttagaaaatataaaccttcaaaattttagtttacaggattctctagacgaaaataatagcttatcaacaggtcaaatccaaaaaattcacctcgcacgctcgctttattctccaaaagaaattctcataattgacgaggggctttcgaatttagataaagaaaattatgataaaattctacttaaattacttgaaaataaggatttaacaataattttgataactcatcatttaaataatgaaaatctaaatctttttgatcaagttattaacctaaatgtttaaaattacatataattttagttcaaaaggctttaaaaatgaaaaagcggtttttatttttttatattaaaatgttacttagattttactcaaaaaatttggtggtaaattttaaattacataattgcaaattaactttaaacttcgttgtgttctttgagttttttgacaaatttatttcttaaattctttaaaaaataccaaaaaaaataaaaaaacgtaataaattaaaattaattacattttaaaaaaattttatataatattttttcctgtatttttaagaatagatgagcatatcctagctcatacatttttgtgctttatctcattagttattttaaaaactataatttttaaaatcaacaaacatattagtgataacaagttatttgcaaacagtcaattaactgaagttggtttagtaacgatgttgcaaaaattaaggcaaagggttgaatttaacactttagatcagcaaatgatatttaaaaatcgcgatggtgttcctagtgatcccaatatttgaaataggtatgatttctactttaatatcttaataaatcagtaaaaaaataggtaattaacttttggcaaaaaacttaaaaaagcgcggaaaaccggacacttttttaaaattatctcatcaaagtgggaaactcgggtgaaattcgattaatttcatttttttagtatcttcataaatataaactaagaaaaattaacattaatatattacaaatttattcatagtaaagcttattttttaaatctaaattagaaataaagtcattcatatattcagtatgaatttgattattttgatctatcggtaattttatttgaatagaaggaatttgatttttttgtactcttccatgcccaatagatttgaataatctttcactaataacaatggctaaatagaatttagataaaggaaattgattaaaaatatttctatatttttcttttaaatcacaaatatttacaaaagaggtagcgccaaatttaaaatcacaataataagttttacctccgccgccgtcacctccattaataatacagaatttatcttgaaaaacttcttctactaaatgattttctagtaaaccaccaactccattattatcttttttagcaattataattggtattcctttttcaaatttattttctaattttctatctatagattgcctttgttttcctttagaaataaaatctaaaattttatcaatagcaaaaaatttaaattttatatttttgtacttagataaattttttttctttaaaattacttgattttctattccagagagtactttacttgcaaaattttctttcatatactttttaaaaacagattcttcaatatcaaaagttctattagtattaaatctttcaaaagaaagttcttcatcaaatcttaaattacgttctaaagcctgtaaaggagaaaattgtccttttaaaattttttgtaattcctttatttttaaagcaaatttatcagttttatatcttctttcattagcataaacaaaaccatcatcactaaaatctattaagaaaatattttgtgtatgttcttcaatttccttcttttttgaggctaatttttgaattttcttaattttttcttgactatatttttctagaacaataattgaagtatttactgctgcattaggttgaaatacatctcttggtaaagaaattatatgacttaccttagccatcataaaaatcctttttaaatattctacatttgctttaacccttccatttaaagaagatttaggtacaatagcagcaattttccctttttcctttaaattttcaagagtcacataaacaaatttaagttctgattctttttgactaaaaggaggattcattaaaactttagaatatttatcttttaaaagaggtaattctttaaaacaatccttttgaattatattactacttccatctccatgtaaaagcatattaattccagctaaagtagcattaaattcatttaattcaatacctattaatttattatttttaatatctttacatgcttgattagaatattgttcttctttttctttgcttaattttttatttttaaaaaaagaataaacatcttgaaacatattcgccattgcattagttaaaaatgtaccagatccacatgtaggatctaaaacaacatcattcatagcatctacttgtattaaatcatacatcaactgcgcaatatgatcaggagtaaatacttcacctttttcttttgcatctgccgagtttcattttctaaacacttttaaaaaagcattcattatgtcatgacctttataatttttatgactaatatttataaggttataaacatttgaaataagttcaacaatattatttaactcaaaaatatcaacagttttaaatgtgctattgtataaataattttgtaaattttgaagcttagattttaaattagtattattatcagaatcaggaatttgatcaatagaagcatttttaatactatctaataaagcagaagtagaatttctgttaaactctatgcttttttttgtattgctatatttgtaagctaacataactataccaataaatggaacagtcatttgtttatcaattttagcttctctaaaagcatttgctagttgttttgcaaatcgatttattaactcttcattattttctttagaatttttaaagtatttttctttgtaatatgtatggttttgaagttctttttcttcatgtaaaagtttaaatttacctttttttccatttctaacataaacatttaaatcttttccattatattgaaatcctataatatcttggtgtttttctaattccatataatcaaataattgattttgaaatttagcattctctttttttgcatctaaaataaaaataacaccatcataaaaatagtatccatcaggttttgtagcttgataaccatttttgtcttttttatataaaggaacagatccatctgtttgatttttaagtcctaaaatggagctgaatttttctacaactttgaattctgattttaacattttcatcttcatcctttacatatttttataattttataattttaccaaaataacaattattaattgatgatttaattactttttttagtaacttatttaataaaatttttaaatagaaatttgattgatgaaaaattaaagtagtataatattcattgtagaagtacaaaataaaggaataatatgaaaagaaaaattacaattacagagcacgatgatggttcaattacaatcaaaataaaataattacatataaatacttataaacttctatattaaaaaaataacttaattgttatttttttaatattaatttatttataaaatcaaagcattcaggaaattatgaaactttttagtatcataaactattttgttaatttaaataaaccatctaatatttttattttttttcttaagtttttattgtattcttttttaaatcttcatttatttacgtattcttatttaataaaatttataaaaaaccaaatagaaattcaaaatccagaatttataacttgaatttgtacttcagctggatcttttgctttgttttttatcattgaattaatattaatttttaaaacaaataatgttttatacaatagcaaaagaaaaaatattaattttttaactaacaaaattgcaaaagaatcttatgattatattttagaaaacaaaacttcatatatttctaagtacaatgtaaatttatcagttgctttttcaatgaatgaattaatttattctattcttttttcatcaatttttaatattcctattactattttatttttgtttttgacagaagtaaatatttgaataattattttacattgcgctgttgctttgattatttctattattatattaataaagttttcttcagttttaaacaaattacaagaaaaattggaaaaaatattaagtttaaatgcaaaaaaacaaatcaaattttttagtttattcaaactattttactttttcaataaaagaaaaatttttaaaaccttcttaaaaaatcaagttttagataaatatacaaaagaatttaaattacttaaacagttttattacaatcaatattttttggaaattattttttcagttttcttatttagttcattaattactttatcagttctaacatatactaaaacatttccttgagaatcctttattagtttattttctttaactactagttttattttttcaatttcttcagttttttcttttactttaatctttaaaactcttacaccttatttagaaatttttattactccacaagaagtaaattcttctacaaaaatagaattaaatgaggaaataaaaagcatttcaattaaaaatttaaattttaagtacaatgaaaatgaaatggtttttcaaaatttaaacctggaatttttaacaacgaaaaaatatggaataatatcaccttcaggaagaggaaaatccacacttttgaaattaatttctggtttaatcactaattatgaaggtcaaatactaataaacaaaaaattagaatacaaaagtatttcagatgaaagtttaagaaaaaatatagctttacttacaaatgaaaatgttatttttcaagatactttagagaataatataagtttgtgagataagaatttaaacaaaaaaaaattagaatttttggttaataaatatggaattttagaattttcagatttaaataaagaaataaataattctgttttatctgaaggtgaaaaacagaaaattgcacttgcaagattagaataccaagatttaaatattatttgtttggatgaagcatttgataatatatataaagatgatgttttaaaaatttataaagattttttatcacagaaaaataaaacagtttttatcgtaagccatcatattccaaaagaaattaagcatttatttgatgaaattattgaattgtagaaaaagcaatgaaccaaccaccaagacatttttgatttattatttgaaactgaattaatgtaacatttactattgcttttaatgtttttagtattatttcaccttattttattttttattctattatcaatgaaaattggttttttcttttgttttgaagtatatcttaccttttaacttcattaattttaagattttttgaaataataaatactggttattttaaaggttttttaattcatcataaaatgaagctttttaagcaattccagtctttcttactaaaagcaacatttaaacagtataatgaaaaatcacctggttattactattcacaaataaacaataccaccgagactattatttctactttttattctgaattgtttaaaattatcaaaattatttctattattggaataactttaggaattatattttacttttcttgaatcttaggtttagttactattttaatattatcaattttctttttatatacattatttttatccaaaaaattaagtgctttattggatacaaaattgaaaaaacaatcagaatttaattcgtctttaagtgattttttaaaaaatttaccaactttatacgttttaaataaaactaataaattagaagatgttatagatataagatatcaaagtcttttaacatacgagaaaaaatattcaaaattatcaacttttatttcttttgtaaataagaatacaagcaaattattttcgtttttatttactatatcgatagttgtattttctctttgagattctcataacaatatagataatgaagtaatatttgcaaatatttctttagtaggtttagtacaactatgttttgattctttcttttccaacatagaagaactttttgattcatttcctaatttaatagcaagttgaaaaaatattaagtctttcaaacaagatcttgtatttaaagtagaaaattctgaaaatcaattacaagatttagatggaactttttctttaattagtattaaaaatttaaactataaattggaagatagagttttatttaataatttaaatttagaagttcaaaaaggtaaaaaatatttactaaaaggagctaacgggtctggaaagtccacattttcaaggattttattaggcattgagaaggaatttgaaggtcaaattttaataaataacaaatacgatataaaaaaaataaatcctgattctataaataaccatattaattatgtatacaacaattcagacttaattaatgcatcaactctagaaaatatttcgcttttggaaccgaaaacaaaagatgagattaggccgttattagaaaaggtaaattttgaaaaccttgatttagacaagaaaattgattctgatgttgataatttttccactgggcaaatccaaaaaatccaccttgcacgctcactttattctccaaaagaaattttaataattgacgaaggtctttcaaacttagacaaagaaagttatgtaaaaatcatatctgaacttattgcggataaaaatttaacattaattttcattacccatcactttgattcagaagtttttgctgaatttgatcaggtagtttcactagattaagaaaaaaaagaaaaattattaaaaaataataaaaataatgcttttttcctaattttttcctttttttagtaatttggttaatttttcttaaattccatcaggaaacaaagcggtcttacgatcgccattttcaaagccatttggataaatttcctttaaattttgtctataagatcgagtttgactcgggaacttttgtaggttagaaccatcaattaaattgtaagccttgatagttttctcgccatcgctaagatcttttgaaagtaaaaatggtgtatatgaagctctggctaataaatcccacctgttagagcttagtgctactccgctataaaccccaatcatttgaccaaattcgttataaacaagcgaaccagaagccccaaaataaagggaggaaaatttgatattctgattaaacccataataatcacctaataggcgatgaaaaacttttgtatatgggttaaggttaaaacttaacattttcccttcataatcattagtggagatagcaaacgtgtttgcattttcaggagatcgatgataagattgcattgttttatcgtttctctcaatgggattatttcaagtaagcactgaatttccaccatcaagtccaggatagcccagaacataaacgtttttggaattagttaaaaactctttgttttcatgcatttttgaagctgtaacataatcaattgttggcatataaaaagaaatttttttatcttgattaggaagatcagcttgtttatttcgttttagataagaatctaacgcagccattgctttttttatccaatctttaagcgtttcatcggcgtttgccaaattaacttctaattcaaaaacagcaaaatctgtatataaaggaataaattcgtctttttctaagctgcttttgataattttgctttctgtaaaatcttcctctggttcaacttgtgattttagatattcaagtcgcaattttgatttattttttatatcatcttgaaagggttttatataatctctattaataaaatcatagccagcaaaaattaatttaggcgctgaaaaagctgttgtttttatagtagaattagctgataaacctgaacggtttgcatttgtaaaattttcatctgaggcataaaatttagcttgattatttttattagtcgaaaaatcataattattattatggcttgcgaaaatttggggagcttgaattgattttcctagtgaaatagaagttgctttatccttacttgggtcttcataatttagtttttttccaagattttcatctaaagtattggataaatgcgaggcaacatgcagatttgtcgcaaaaaataatttgtaattattttcatcttttttatgataatctaacagtcaaatagtcccattttcagttgctaaaaacttattctcctcgggttcaccataaagtttaacacctttagctaatgttatgccaaattttactgaaaatgttcgatcgtacagttccttatacaaaatttgaggatcaactgctttatattttttagcaaataacggatattcgtttgcctttaaattcttagttgcaaattgaggaagctgaaacacatctggtaattgcaagctattattaggatttgcttggcttttatcaggaagaacctctacttgttttttttgtgtttttgaatcaatattttcgtttttttcttcttttttggtttctttgatttcgttacttatttgtttttccgacactttatcatttttacaagaaattaaaaagaaaaaagcgggaattattgctaaaaataaaaaatttttaatctttttcatatcaatctctagttttttctttttaattttaacctttttttttttttttttttgcaaaaaaaggtaaaaaaataaaaaaacacactcaaaagtgtgtctttttaaaaaaattaaaataattaagattgactttagcttttcgttagagcttcttgaggaatctcaacttgttgattttttgtaaaatcagaacttaaatattcttggaatgtgtgggcaaatagatctttttgacttgaatctttagttaatttgtccaaatattgaccatatttaattaaagaatcaatatattgaactccctcataaactttttcaatatccctgtttttacctagatttaacatttgatagccgtccccgcccgctgaaagataatcatttgtgcttaaatagtaaaatttgttatcatcaatcggcttgttattaattttaaaggatgttgtatctggttttcaaacccaggattctattttggttttcggatcagtccctttttcaactttgactttataggaaatatttgaagatagttgggcaaatgcgccttgtttccccatagaaagtccgtattcgagagtttttttaagtgtatctccttttagtttaatagttacaatcctattcccaaaaggactaacccctaaaacatctcctcttttgatttcaccactttttagatctgttctaagactaccaccgtttataagtcctaaggaattatcaagtgttgcaatttcatttttcgtactttgtacttgttcttttgaactttttgcatattcccaagcaatggcatctgctgtcattacccctaatgaagttggttttacccgtccaattcagtaaggagttttgttgatctcaattgattgaacatgttcaaaaacaccaggcgaattaaatacttttacatcattttctacatcataaactttatgaagttttttgatataatgttctgataaatctctggttacaatattgatttggttaatatctcttaaagattgtacaatttttactatctcgccagtttcagtatcaaaaactaaatcaatgtccccgagccattttgcataggcctcagtttgggttacccaaacttttttatcttctttgggtttgtgaatttcgatttttgtatgcgaatgcccatcgatgactaaatcaaggccatttccggtttgttctgcaagataatctgaagttcatttatgttctgtgcgcccaacacctaggtgcgttgtagcaattataaaggaaattgaaggatctttttcctgaatctccttaattaccttttgggtttcaggtactggatcggtaaattcaactcaaaaagaattttttgggtgggaagtaatttttgtatctggagttgtcagcccgataactgcaacttttagaccattttctaattcctttattatataaggttggaaaactcgcttcccttgtttaaattcagctggttttatggctctttcatctgtagattctaaatttttaagttcctcttctgaaggttgtcttcagtaaacattagcggaaataaaaggcatttttcggctaaattcatctttgtttccctcggcggcaagatcaagaatgtgtctaattccatagtcgaattcatggtttccaatcgcaactgaatcatagcctatatatttggcaatttttgcaattgtcttacctttatctgtatccgaaagtggaagtccttgaattaaatctccggcagataaaagtaaatccttgttaaattttttcaagtactgtcccgttttatccatccctgaataattattgtgtttgttatcatcatattctaagcgaccgtgttcgtcgtttgtatgaaaaatttttacagttttaagttttgaattttcttttttttctaattcatgcaattttttaaaaagataattgacctgatcaattaggggatcaattttggcttgggcttcgctaataattatagcgatttcatctgtatcactttttggattagttttacggattttgtctatttttgcttggaaatcatttaaggtatccgaatatttctcaactacagaaaaatattcttccctaatcttttcagaattttctttaacttgagcgctattttcagttattttttgagtattttttgtaacctgagtagcgttttcactacaagcagcactaacaattaaaggaattccggtaataaaagttgcaatagtgcaaaaaggtaataaaagtttcttcttcaattttctcctcttattttttgttaaaattgtattataacttaaacgccttaaaaaagaagaaaatttcttaaaatttttcttccttactttgtatatgaataaaaaatttgtttaacctatattatcgaaaataattttgggcgtttattaaagccgaaaaatttttattaatttttaaaaaacacttgtttttatagtattttttgggttcaatataattttttaaaaatttttttaatttataatttttttctatgatataataatttaaaaatttagtttttaatttcaacagcccacaaaaattaaaaaaataaataaaaaagtataaaaatttttaagaacgaaaaaaaatgataataaaattacgaatagttcttttttcattgttttgattgctaaaattacgtaaaatacggtctgtttgaaaaaaatacactaaaaaaaaagtcgaatttgcgcctgaatatcgaaataatttaattttaaaatactcaaaatttattttaaagctttttcgacttaaaataaaagtttttggctatgaaaatttaccaaaaactgctgcagttataatttcaaaccataattcgtttgctgattattttgttttatgctcagctctcgaaaatcctgaaaagggcgaaggccaaacaaaccctatttcaacttttttacttgaaaaacagtattttaatcgaaaaaacaaatgaatttttggtattttggattcactttttttgaccgaagatccaaagaaaaacatcgcagaattaggaagtttcttaaaaactgcccgggaaaaacgtatttatggtatcgtttttagtaagaaaaatgaaaaaaaatcaaattttgacttccctgttaacgtttttaacgccacaaaacagactggactagcaataattcctgtttcaattaatttttctgatgaaaattcttataaactgaatcgcaaaaaagtacaaaatattgaaattttttttcataaacctattaaaaccgccgctgtttttgcccagacaggcaaatctctatttctaactaccaaaaaagcaatttttcagaataatggcggtgataaataatgaattttgatggcaaatttgatgttaaattaggcaacttttccggtcctttagatttactacttgatcttgttaggtcaaaaaatattaatattcttgatattaatcttgtcgaacttgctagtcagtatgtaaatatcattgataatttaaagcaaaaaagtattcaaattgctggggagtatttagtaattgcatcaactctagttcatttaaagtcaaaaattatttttgcatctgataaacaagaagaattagattctgaaactaaacaggaccaacttgaatttttagcactcctttcggactaccaacaaattaaaaatattaccaaaatgttaaaggagcaacaagagcatcgaaatgactattttgagaaaagcacctcaaattatagtgattttcgcaggccgcataaccctaacaaactcgatggacattcatcccaactaattttatcgaaggttttaaaactaatgtttgatcgaataagggcaaaaaatcgtttaaaaattagcacaaaacaagtagaggtcagcgctgataaacaaactctttgactcaaaaatatcttagaaaaaaaaggcaaatttagttttgaagaactttttaacctaccgagtatgaaacattttgtcatcacgatgatttctctacttgaaatggcaaaaaaacaggtgttgcacttaaaacaagaaagtcaattttctgaaattttagtttttgaaggaggttttgatgaaaactagaattattgaggcaattttatatctccaaggggaaaaaggagtttcatcactccaattacaaaactgtctaaaattagcaaaaattagtgaagcgcgcaaacttttaaaggactttgccattgaattcaaccggcaaaaacgcggaattttagtggttgaatttgatgatattttcaaattcgttaccgcaaaagacctaaaaccctttataattgattttgtcagcaatgaaagaaaataccgcctgagcaattcatcaatcgaggtagcagccataattgcatataaacaaccagtaacacgcagcacaatcgcacaaattcggggcgggattaattcggactacattgtcggatctttattagcaaagggaattatcgaagaattagggacggcttcaacacccggaaatccgacgctttatggggtaacttcaaggttttttgattattttaaactaagatcggcaaaagatttaccaaaatttcaagaatttgatctttttagtcatgaagaccaaaattcacaggtagataattttgatcttttttcatcccaacgcgaaaaccaaaaatagttcaatatgaaactaggtcaaattagtgccaaaactacttttgaagaacaaaaatttattttttttaatcaagattttccgcttgagataactaattcaaaaattattggttttatttcaaaccagtcaaattcaattaacgaaagttacatttctagtattggattagtgatagcagagtttttaaagcaaaataatttgaaaaaaattcttataaataacagtgataataattttggaattgcttttggtttaattttttataatattttagcacataattctgaaataaaagttgaaatttttgatgaaagctgaggttattcccaaaaacttgcccaccattattttattaacaatgattttgatttttttattaatattgaagttaatttaacagataaaaattcaagtcttgcaattttgtcatttttcaaaaaaaatttgacctttttaagcgctgatgacgaaaaattaattaacaaagccgaaaaatgtccttttttatcccaaaatagtcaaattaaaaaaccaaaaaaattcagaattaattgaaatgatattatcgaattccaaaaaagcataaatttagacttgcaaaagttagaaaaattctatcaattttatgaacctgaatcgacatttttaactaattttttaaagcgaaactttgacctaaaaacagctaaatttctgccaatcagaaaaaatgctccaatcgaaaacataatgaaaaaaattagcgataattcgataatatggaaaaaaatcacaacaagcgctaaattcaaaacaaatgtagttttttgacttaaacagaataaaattcttgctggctttcgcaaaaattttaattttaatatcataaaagaaaaagatttacaactattatttctagattaccttcgaaaaaattgacaaaatggtagacattttttaattagcaaacaaagtgatagttatatttttgagtttgttcaaaaaaattttaatgcaaaaattaaaagtttttgtgaatatacagaaaatcctgaaactgaaattatcaaaattcaatcacaagaacagcaagaaattgtaattataatggaaaaaagtttttattttatcccaaaaagtgctgaaaaatcaactgtttttggcctaagttcacatttttcagtgctttgatatataaaagtttttgacttttatcttaaaaataaccaaaatattcttgagataatccaaacaatcaaaaccgagattaactatgtcttccatcacaaatttaagttaaaaattgatccagtaaaacttgataatatcataaatctacttatttccgaaaaagatggtgaatttaaacctcaaggctttaaaattaaaaatttttctaatgataaaaatgttataaatcttaaagttaatcttaaaaaaaaggatttttacacgctaacttattttaaaccaaaaaaacaactcacattatcgactaattttttagcaaaaaatcacaccgaaaaacaagctgtttttctcgaaaattctctaattgataaaataaggcttgtaaataaagattcaattttaacaaaaacaaaccagaaaaaaaatataattaaattttcttgttttattacaacaattattgtaatcttaataattttgttttataatttctataattctagtttctctgatggctcgacaacaagaatttttgaaaaattctacgaatttttctttaaacctaggaaaaatcgactagttttcttaggagtttttggccattttcttttatgaaatattagtacaacctttcaattacggcaaatttttaagaatcaagggattaaaacaaaatttaggcacctatttattggtacttttattgccctttttatgcagttttccacaccattttcatttgggggagaaataagttattactggtatttgcaacgaaaacaatacccattaaaaaatattagcgcgactttgacttacaacgctttacttcatcaagtttttaatttgttaattgctattatttttttaccagttggttttgttttttatcctgagctttttgtttttgattcctgggaaaaaattgccttttttacttgattaattacaaatattattctaaatgtgtttgttttgttgataattataataatttcactttgaaaaaaattacaatattccttaattaaaatgcttgtctggcttttaaacctcaatttttttaaaaaaatgaggacaaaaaaagagttgaataccgttttcaatttttaattgacaattttaaaaatcattttattaaaatactttccaataaagccttattaacaaaaattcttttaatttataaattgccactgttttttcttaatttttcttttgttattttaataacagcgatggaaaagggaggatttaatctaaaaaaccttagttttatacattatttgaaatttatttcaggatttacaatcctgcaaatttcaaataatttatcgccctcaccagggggagttggttcggttgatgttattacaaaattaatttttcaaagtttttttaatgaaaaaacaactataacattggatatttttaactttgcaaacagaatttatacctgatttttgccttattttatctcagcactcggaattctcactgtctgaattggagaaaaaagaattgactattaccagcaaattcgccaaactatgaaaaataattcaattctaaatcttgaacttaaaaagcagaatactaatttttttaagtatgctttatttttttggactttagttatattttctttaattttatttatttttcttcattaaatttaagaaaaatttgagctgcttttgctatcattgccccattatcagtacagaattctttttttggaataaccactttatatttattttcatatgttttaattaatttccgaatttctgaatttgccgcgaccccacctactaatgttattgtttttacattttttttagttttaagtgctaaatcaagctgcctttttaaatattttataactgttttttgaaaagaaacagcaatttcaacaacttttttttgcgaaaataaataattttcctttaaattattagtataatttattacttgggttttaaggccgctaaaagaaaaatctaacggattttcaagtacttttggcaggctaaagtcaattagttccatatttcttacattattttgttgccaaattaagtcaattttaggtcctccggggtaaccacaacccaaacttcggccaattttatcataaatttcaccaagagcatcatcaactgtcgaaccaataatttctaaattatttttgttttcagcaaaaattaattgagtatgaccccctgaaatcaacaaggataataccgggaattctaagtcgttttcgattgcagccgaccaaaaatgccctaaaagatgatcaattggaattaacggcttattaaaaaaaagcgagagcgcgctggcaaataaaaacccaatttttaaaggccctatcaatcccggattttttgtatatgcaattgcatcaatagtggaaaaatcgatattttttcctaataatttctctaaaattattgctaaattgcgcgaatgctctcgcgatgcaagctcaggaactgttcctccaaattgttcatggagttcaaattgactaattgttaacaaaatttccactttattttcgctaaaaagtgcaactgatgcatcatcatgtgaagtttcgattcctaaaattttcattttacctactttttttaattttttatttttattttttctatgttatgttataattataatataaaacttaaaatatataatatgggtcagtactcaagaggctgaagaggacgcactgctaacgcgttaggggagttaaatcccgcgcaggttcaaatcctgtctgacccgccataatttataatattgcttgataaaaattcgttttatttctaattttatcttgttaattgataaattatactcttattttctttacaatattttattgtttttattaatatctaagattttttaaatttcttttatttgttttatattaaattttttactacgaaaatattaaaaaaataattatttctttttcattttttagtttgatattcattttattttcctttatatttaatatttattataatttgagtatatcatttaactaaataataatacaattaaagcaataaaaaaccagaaatttcttaattttgaaaatttctggtttttttttattaaaataattcaatatattttagctatttatcaactttttttagatttttatactcgaaagttgctggagttcggcgaccaaaaacactttcaagctcgacggttattagggttttagttacattcatctcgatgattttcccaaaatcatcagaaaaagggccatgggttactttcactcaatcaccgatttctcaattaattgtgccgtcgtttgtttgttgaaaattaagaatttgttgatctcatttttttctcattctttcaaattgacgcggtgaaattggtgttggttttgttcctctaccatgagacccgacaagtcctgttacatattgggtattacgcaccacaaatcaagccttgtcaaccatattcatcttaatgaaaaaatatcccttatataaatttcggtatttcagctttttttctcctggtttattaggattttcttcataataagggacgtcaaatttcgttatttcttggaaatgttcctctaaattttcgtattttatccgatttttgagcaaactaatggcagtatcctcttttgaagaaatagttgaaatcatataccacttgtaaattttcataacaaaactaaccttttttttaaattccgacgccagcctgattccaaataagtgccgcaataaccgtaactgcaaaaaaaacaaacataaaaattgtggaaaaaagcaaggattgaccaaaacttttaaaggtaacacggccgctaggccatttcactcttttcatttcctttataaaaagacgaaaataatacttctttttacgtgtttttttcagttttggcgttttaatcggtctttccaacttttttccctttctatttttcttcctgatgtaaggttgatttacggcaaattttacaaaatttattaatttgcagacgattttgcactgatttgcttgttttataattccgatttttacacaagctgcaacttaaactaattttctttttcatataaattataaactaaatttattagataacttataattataacctaaaaattaaaaaaaactacgtaatttattatttgttagtcgaataaaatcattgactttctgggttgtaagtcctatttttttagcaatctcctttgtcggaaagtcctgaatgaaaaacatttgaaaaatttcgtattcaacttcatcaagattgctagtaattcggttgtaaatatcttgaatttcatagtattcctgatcggattcagctgcaaattggactgtttctgataagtcatcaagtgaaattgaaaaattggcaatttgataattttttgttgtaaatgaagttgcataacctaacataaacaatttaattttatgaactaaataattttctagtggaattcccaaactcggatcaaattcttcataaagatttacaaatttttcaattgaagcgttaaataaatccaaataagttagcggaatttgattaaaagttttcattacctgttttgaacaagctaataaaatatgtgaatatttatttaaaacctttaaacagcgtttatttttttttatcttttcttttcgctctggtgacatagaaaacacattttttccctttatatttttgttttttttatattttgttttagaaaaaaaagaataattccggtcgcgactgtcacatttagcgagttaactgttccttcaagcgggataaaaaaagtttgatcacttgcatttaaactgctttttttgattccagttccctcattacctaaaattattgcgcaaggataattaaactgaatttcctggatttttctacttttttctttaagatcagtggcataaattcaaaaatccatctcttttaatttattaattgctgaaacaatggaattaactaaaataaatttaaggccgacaaaaccaccagatgagactttcatagtggtctcattcaattttgctgctcgccttttaggtaaaattatatgcttaattccaaaacaatttgcagttctaatgatatttccaagattattttggtcctggatatgatcaaggatcaaaataatttttggtttatcttttactaatgtatcaatttcaaaaaatttaaaattctcaagaacaccaacaaaaccttggtgattcagtctgacaagtttatctaaaaaatcacgactaactatttttactttttgttttaagaaaatttgatcatttgtaggttttaaaaggtaaatttccttaaaaataaacccattcttgatcgcgtcggctaatgaatttctgccacaaatatatttaaccatactttcaatctttcaaaaggaagatggaaaaaattatgaatttttaaatatttttcataattcttcacggattttatcggcctcggaatagtttttatccataattaatttgtttcaatttttgattttttcctgactttcggggtccaaacgcatttttgtgaaattaaatcttaaatttagaaaaatttttcttatagttgaattttctttttgttttattaattccataattaaaaaattagcttttgcgaatttgccctcaataaataaattaagcacttgttcaactttttcagtcttttcgttttttttgtcaaaatatcactcaaaacagatcttttggtatttttcgattaattttttatgatttttaattaattcttcagttaaattgattggaactgttgggtttattgacaaaaaaatacttctaataatatctggattatatttatgcgaaaaattctttgccaatagtacattattcagagatttggccattttttttccatttaaattaacaaacccagagcgaaaccagttttcggcaattggatttcccgttagagcaaaatgttgagcattttcgttttcgtgatgaggaaaaattaagtcaaccccgccaccatgaagatcaagtgattttttttgaaaataatcatagataagtgctgcacattcagtatgtcaaccaggtcggcctaaaccgaacaaagacttaaaaaacaagcctttttgggttttttttcataaaacaaagtcattttttgactttgtttttttagtatttttatccagtaatgattctattttttgaccagaaattattccgtaattaggaatttttaatatgtcaaaaaccaagtcattgtttttgttataatatgtaaatccctttttttctaaaagttttatatattctataattttttctattttttcggtcaccttaacgatttttgttggcttttttatattaaaaatttctaaaattttaaaatattcgttagtatatttttctgttagctcagcctcagaaatgcctaattcttgtgctttttcaataattttatcatcaatatctgtgatattatgtaaaaaatttatcgaaaaacctttgtttttcaaacattcaaaaatagcatcaaaaataattatagttcttaaatttccaatatgaacatcgctataaactgttggcccgcaaagatagatatttaaattttttttattaattaagttcatagtcatttaattttctaattaattccttataattaggaataatttcagctactttttcccaaaaaagtttattatgcttgctaaaaaaatggtgcacaagttcatggacaataacataatcaatgatttttttagaaaaaggaagtaaaaaatagctataatgaattttttttcgccgataatttgttccccaggcagcatttttacgcgctattttgatttcatagttgggaatttccaaaatttgagctcaataatttgtccttttttttagataatttaaaaaaaaattcattaaaactttttgaattttggcttctaaatttcgcgctcttgttagggagaaaactaaattttcagcttgtaaaaaaagtttattttgcgttttgactaaattatagtagtattttttgccaaaaagataaaaactagactcagaaaaattaagtataacacgttttggcaaaattttcactactttttgaaaaaagttagaatttttaactatttttattagttcctcaagttttactgccggatttgaacgaaccaaaataaaatcatcaaccatttttattataattttagaaaatttgggtgaataatcaagaaaaattgtgtaaaatttaccttgaaattctaaaaccaattttttatacctggttttcatttttggttatttttacttcaatgttgttggcatttttactaattatttcgaattctaaactatataaaggtgatctaaaataaattttatctcctaaaatcagcttttttttgggtttttgggctaaaagtcattgatttagatctttaaaactcacgggcaagtcaacctttaaagctttgttaattgttacaatatttgtctcagccttagttgtaatctgatttggattgatctggtagaaatctagatcatcacggtagtcatattcatcataaattggcccgaataaacattcaagaatatcctcaaaagtaagaattccaattatttttttattttctacattatcaatgacaaaaccaaggtgagattttgctttttttaaaatttcataattagtcttaatcaaattagtcgccaaaagtaaaggagtttcgacaatatggtcgttaatgtcgaatttatcaagatacaaaatatcttttgaaagtagaattccgatgaaattattctcttttcagactggaattcgcgaaaaattgtgatcaattatcacattttttattgattcaagactatcttcgtaattaacatagacaagatctttcaattttgtaaaatgttttgcggttttaaaagagtcaaaatcaagcgctctgatcgccagatctgattcttctttttcaagaacttcttcgcgctgggcttgcaaaattattttttttagctcattttcggtattagtaacatttatttttttgacaaattttgtcatcaaggttgcaagtgggtataaaaaataataaaaaaaaccgataaaaaatcaaaaatattttaaaaataaaatcggttttttgcgcccgaaaatctttggataaatttcgccaaaaataattaaaggcggggttgttgctgcaattgagatcaaaatctgcagtgattcattaatcggcaaactggaaaaaaaagtcgaaattataatcgaaattccgatatttacgatattatttcaaattaaaatgattgttaaagttttttcataattatcataatagcgtaaaatttgcttttttccccagaaagaatcagcaatattttcatcaacttttacccgacttgttgcagtaaatacagtctcgcttgcagaaaaaattgccgaaataaagaataaaatcactaaaacaacggataaaatagcaaaatataaggccattattcatccaatcctaaattaatatttgcttttttattatatgaagactccggaattgcaggactaaacttgccaaattcaggaaaaaaatcaaaaaataaagttccaatcggtccatttctatgttttgcaattataagtttcgtatttgggccctgttcttgatcgggtttctcctcttttttgtgataataatcctcacgatgtagaaaagcgacaatatcagcatcttgttcaattgctccagattcccttaaatccgatagaactggggttttatcctctcttctttcaacatttcttgaaagttgtgaaagtgctaaaataggagtttcgacctcacgggctagttgttttaattttcttgaaataattgatacctcgacttgacggttataattttggtttcttgtagctgaattaattagttgtaaataatcaaaaataattaaatcatattttaggttatttcgatatcttttttgaacttgtcagtaaatatcatcaatattaatcgatccagagtcattaattattaatttacagtttttaattcgggtttcaattgccttttcgattgcttttaaatcttccgctcttaaattttttgggattttaaattttccagattcaaccccagaaataagcgaaagaagtcttgtaactaaatcagaattagacatttcaagtgcaaaaaataggacagatttatcattttcacaaatatttcaagctaaattaagggcaaaagctgtttttccgactgaaggccgggctgctaaaattgttagatcacctttttgaaatccagaagttaataagtctaaattctcatatccggtcgaaattcctttaattaaattttgactagtacgtaattctgttaaatatgcgaaaatttgaactgcaatctcataaatcggaataaaagtttcatttttagtattaaaattcagaagatttattttttgaagaatttctgtggttatctcataagaaaattttgttccggaatttagttcttttgttgaatcatcaacaattttttttagatctcttaaagtttttttttcatttattattcttaaatgttcagtgatttccgaaggtagcgaaaaattgctgttatataaatttacaatgtagttgcgcccgccgatttgatctaatttacccgttctttcgagttcctgaagaactagggtaacctcaggattttttgtttgatttgcaacattttttattgctcttacaatttcagctaaatttctaacactgaaatcatccggattaagtatgtcaataaaattaacaactttttcaggatttgctaaaagaaaagagatgataaatgcttcaagttcaggagaattataacgagaattattcatcttttgtgatatttatttttaatttagcaatagtttgagaacttaattttatatcaacaaaactagtgccaaaagtggaaattccacttgtttggattgcttgtttatcaacaaaaatccctttaatttcaagttcttttttaatttttttagctgtaattgccccatgaactgattctttatttccctttaatttaaaccagagaactagcttttcaatttcgatttttagtttggcaatttgttcctgtttttcttgtttttcgatctcaatttgctgttttcttttaactaaaagtttttctgttcgggcatttaggggctcggctaacttattcttgaataaaaaattagtggcatagccaggggaaacatcgataattgtattcgcttttccatcttttgtatctttaattaggattactttcatattctctccttttaattgctagtttgatattattgacaaattcagaaaaagtctcaactgttgaataagcggctgccgaattaaaactaccacccccaccaacctgctcggcgatatattgaacattaacagtttcaagacttcgagctgacattttataatttttttgttgcggtaattttgcaacaacaaaagcagcttgccgatttttaactagtaaaatttgatcgcaggcaattgcaacaagatcggtatcaatttcacgatctagacttgaaagaaaaaatccttctttaatttcaacaacattttctaaaatttccttaattgtttttgattctgactcgtttagtttaagaaattcggctgtttttgctgtttttgcgccccatttaacaagagccgaaacagctgaaaatgttgaagaacttgctgttttttttagttgagctgagtcaatataaatcccatttagtaaaatttgggcccattcgggatcgatttttagatcagaatgaaaggttaaaaggattaaatgcgtgataatttcgcaggttgaagaagaagaaacatcaatataatcatgaactagctccaaaagtccttgcattttcggggaaattccgtgatggtcaaaaataaaaacgttttcaagactgatatggtcaaaagctttaggattttcaattctttcaagatcagagacatcaactaaaatggcaagacaagtatcattattttttgaagctaaggaaatttttgttgaagtagctggtgaaataaaaatttcttttttaattattgattcagactgggataaaaatagtgtggtggtaggatcaaaggtgcgattctggatataaaaatttaccttttttttatagataatttcggcatatctttttaaaaagttacctaaaacaaaggctgatccaaaagaatcaaggtcagaattaatatgaccataaatgataattttatcaattttttctaatttttcaaccaaaatccgcgcaattcgttttaactttacaagtgaatgatgatttaaggattcgctataagatccataagaaaaaggtttttttccatagggataaattgaaacctgattaccaccgcgcgcctttgagaaaattagggcttcgtttgccaatcttttgatttcgactagatttgtagtggcaattccaaaaccaacagaaaatcaaacttgagttgtatcatcaattttcgtatttttttcatgaaaaatgtagaagtgatttttctgtcaaatcataaaagtttcataatgaagaactaacataatccggccatctgcatattctttgtataaaaagccaaatttttgtgctagtttttcaaagaaatcattaataaaaattttgattttaggatagtcttgatcactactgcgaaaattagaagaaacaagattatccacctcaatttcggcaaaaacaagcgaattattctcatatccctgcgaaattgacttaaaaagtgtgatatctttataagaaattcaatagtcaaatttgttaaaattaatctcaaatcaattatttccccttttgatctcaaattttgagggaatatcttctgtttttttatactgggggaaaaggtagaaaatatcgcgattaatcagtctttcaggatataaatttttaacatattttgaaacttttactattttataggtcgatgataaattaattattccaagattgttttcctcatttattagatcaaatttttgataataaaaatggttttgtttggtgataaattggtataaaacaactattccaatggataaagagatgataaaaacagcaaaaacaataacggcaacggcaaaaaaaaggtagaaatcaaaactatcataaaaaataacctttaataacaaggtcaaaatttctgctaaaaagcttataaatgaaactgaaaagggaaataaaaattttttcatattttaattatttttgagaataaaatttagaatttttctcgggatataaatgacttttattatttgcttattttgcaaatagttacgtattttatagtcttttttggcaatctcgatgatttcttcttgtgatttttcatctgttaattcgagaattccgcggtttttcccattaattgaaacaggtaaatgaaaagtatttttaaaaatttttgaccgatcaaattgaggtcaaatctggaaatttaagggtttttgtcctaatttttcaagtaattcttctgctgtatgcggtgcaaaaactgagaaaataattaaaaaatctgtcagataattttttgaaggaattttttgctttttatttagaaaattaatgtaaaccattaattttgaaattgccacattgaacttaaaagtttcgattaaatttgtgatttcgaaaacaaaattattgaaaaaatacgtaaattcatagtctttttcaagttcggggtcaattttatagtcagctaaaattgttctttgtacccgttgaattcagttaaaaattgaaactactccattttcatctcaaagtcgaagatccccaatcggacccataaacattaaaaaaattctaattgtatcagcgccaaatttgtctatgatttccgtaggatttatcgtatttcctttagatttcgacattttttgaccatcagaacctagtaacattccttgatgaattattttttgaaaaggttcagaatttggaactatccccgcatcaaataaaaccttatgtcaaaaacgggaataaattaaatggccaaccgcatgctcctgaccccctatataaagatcaactggcagccattttttgaatttatcataggcaatttttgaatcaagcggcaaatatttatctttttcttttaaaataaaagctagataataccatgagcttccgcttcattgtggcattgtatttgtttcccggcggtagtatttcccatttttttcaaagaaaactcagtcttttatcgatgcaagtggggactggccatcaccagaaggcataattttatcagtatgtgggagctcaactattttctcttcaagataaatctttcctttttcatcaaaataaaccggaaaaggttctcctcagtatctctgacgggaaaaaactcaatcttttagtcgaaaaattgtagttttttgaactaaattcattgaatttagcttactgaaaatagaatttgctccctctttaatagtcaaaccagaaaattctgcagaatttataagtaaattttcttgatttattactttaacataatcaatttggaaaatttgagcaaattctaaatcagctaaattatgggcaggaacccccataattgcagaagttgcatagttatttagaacataatttgtaatataaatcggaattttacttgaatttaaaggatgaaccgcatataatccagtgaaaattcctgtcattttactttgtaattttggacttgaaaagctgttttgctcaataaattggctgattttttccttatttttagccaatttttgagcaaaattatgtaaaggtgcaagggctaggaaacttactccataaaaagtttcgatttttgttgtaaaaatttcaagaaattcaccggttttttcaattaaaaatttaatttttcacccttttgatttaccgattcattttttttgtaaagtttttaaagaatcaggaaaatcaacttgatcaagtccatcaagtaatttctgtgcatattcagtgatttttaaaactcactgtttcattttttttaaaattacaggaaaatttcctctttcactgacaagcgcaccatttttttccctttttaattcctcatttgctaaaacagtgcctaattccgggcatcaattgacttcaacttcgcgaatctcagctaaatttgccttatataatagtttaaaaatccactgagtttggacataaaattctggatcagaggtgttaatttccttatcccaatcataagaaaatccaaaagaaattatttgttttttaaaattttcaatatttctttttgtaaattcacccggatgattacctgtttttatcgcatattgctctgcaggcaaaccaaaagcatcccaacccatcggatgaagcacgtcaaaaccatttaaacgtttaaatctagcaacaatatcagaagccgtatagccaatcggatggcctagatgcagaccagaagccgaaggatagggaaacatatcgagaatataggctttttttctagatgtctcggttgttttgaaaaccttatttttataccagtaatcttgtcactttttttcaatagctcggtgatctaacatgatagttacctaaattatagcataaatttttaaaattaaaagccaaaagtgacttttctaaaaaggaaaaattagaaatatttaaaaaagtactaattccaaaagcattttttgaatataaaaaccaaaaaatgcttaaaaacaaagatgttttgtgttaaaattttcttaaaaaattttaaaaaagtaatcggttttaatatgttaattgaaaaagaatttaaaaaattcaaactagttgcaaattataaaccaagcggtgatcagccaaaagcaataaaaaatttaatcaacgggataaaatccggaaaaaaatcccaagttttgcttggagtaacaggatctggaaaaacctttacaatggcgaatgtaattgcctattttaacaaaccagtaataattttatcacataataaaactttagcctcacaattatatagtgaatttaaagagtttttcccggaaaaccgcgttgaattttatatttcctactttgatttttaccggccagaagcttatttgccaacaaaagatgtctatttagaaaaaactagtaaaacaaattttgaccttgaaactatgcgaatgtcagccctaaacgccttgatgatgcgaaatgatacaatcgttattgcctcagttgctgcaatttatgggaccttaaacccggatgaatatcaggataatttcttagttttagaggtagatcaggaaataaaaccaaatgaattagccctaaaacttgccagaatcaagtatgaaaataatcaaattgagcaaaaaccgggaattttttctttaaaaggtgatgttttagaaatttttccagcttgaagcgatgcttttaatatcagagtggaattttttggaaatataattgaggcaataaacataattcatccagtttcaaaatcaataataaaatcatataattctttcacagtttatcccgcaactgcttatagtgtgaaaaaaaatataattaacagagcgatcgaaaccatcaaaattgagctgggtgagcagctcgaattttttgaaaaaaataataaattagtcgaaaaacaacgactaaaagaccgagtcaataatgatattgactcgctttctgaattcggaatttgttcaggaattgagaattatgcccgccatattgacggacgccaaaaaggcgaaaaaccatttagtttactagattatttaccccaagacggcctaatttttattgatgaatcccatattatgatcagccaaattaagggcatgtatgaaggtgatcgaagccgaaaacaaaccttggttgactatggttatcgactaccttcagctcttgataatcggcccttaaaactcagtgaatttgagaaatatcaacaggcaaaaatttatgtttcagccacaccggccagctatgaaattgataaaacaaatggcgaaattgtctcgcaaattatcagaccaactggactaattgatccagaaatagtaattgaatctaccaaaaatcaaatggagaaaatttttcagtatttgctaaaacagaaggaaaaaaaagaaagaagtctcattttaactaccacaaaacgactggccgaagaaatcagcaagtatctccaggaagaaaaattacaaaatgtctattatttgcactcagaaatgacgacttttgagcgcgatgaaatcataattaagcttcgaaaaggaatttatgatgcaattgtcgggataaatttacttcgtgaaggcgttgatatcccggaagtttctttgatttttgttcttgaagccggtcttgtttcttttttgcgatcagaatcttctctaatccaaattatcgggcgggctgcccgtaacgatcatggaaaagttatcctttttaccgatacagtcactgaaactattgaaaaagttttaaaagataatgaaaataaaagaaaaattcaaattgaatacaaccaaaaaaacaaaattatcccaaaaacaataaaaaaaccgattcccgacagcatcaatccaaacagtttgaaaatcagcaaagtccttcgtgaaaaacaaaaagacaaaaaagagatggaaaattacatcaaaattctcgagaaagaaatgaaaatagccgcagatgcaaaccgttttgaggaagcaattcaaattcgtgatttgattgccgaaattaaattaaaaatttaataaattataagaaattcagctatgaatacaaaaattcagataatttttgggcaaaaaggtgctaatttgacctttttagattcacaaagtcaaaagaaaataaaagtgaaaatcccaatttttacaatatgttttcaaaaaaatataccaaaataccttaattttaatctaaaatttattttaaaattaagttattttgaaaattttatttattgacttattgagcaaaatttacttttagaaaaacaaatttttcagcaaaaaatgctgaaaaataaagtattttgtttaaaaatggtaaataattttcacttgttattctgaaaatatagttttaaggatattataatttttattgaaaatgatgaaaattttgcttcttgatttaaacaaaattttcatattttcaaattagaaataaagaaataccaaaaactttttctgacaacaacagatacagttccgggaattgccagtttttacaaaaattgcgatttagatgcaatttttgtaatcaaaaaacgcgatttttcaaaaaaaattgttactttagtagctaatttagaacaaataaaaccactaataaaacaagaaaattataaaaaattaaagaaaattacaaaaaaaatctggcctggagctaccactttaataatagaaaatcaatcttttcgcatcccaaaccaggtcaaacttcttaaacttcttaaaaaaaacgggccagcatttgtcacaagtgcaaatatttccaatgaaaaacctctagatcttgtttctgcaaaaagaaaattttggcaaataaccaaaatttttaatttcggacctggaacaggaaaagtttctagagttttcgaccttgataataaaaaatgaattagaaaataaaaaaatccctaaaaaagggattttccaaaataatttgatatggtgggaacgaatgggatcgaaccatcgacctcacgattatcagtcgtgtgctctaaccatctgagctacgctcccgtaaataactattttttaatagtttttatgttaattcattaaaattataacaaattttttaaaaaatgaattaacgttttgaaaattgccttgctcttctggcttttcttagtccaaattttttccgttctttggcacgggcatctcgagttaacatcccagcaacttttaatcctggccggtagtctgcagaaactttcaacaaggcacgggcaattccaagtcgaattgcgccggcttgccccgaaattcctcccccatgagcattaactctaatgttgaattctgaaactgtgtttgtaattgacaacggctgcaacgcatctttaatcaaaatatcggattttaagtactcttttgcaacacggttattaattttaaattgaccatttccgtgttttaaagttactcgggcaactgatgattttctacgtccagttccataatatgataattctggttgattcattttctattttacctctaatttttccggattttgacctaaatgtggatgttctgatcctgaatagacataaagatttttgcgctgcttatcccctaattttgtatgcggaatcataccataaatggctctttctaataaagcaatcggttttttcgcgcgcatttcacgggctgttctcactcttagaccaccaggatatccggagtgattatagtataacttttgctcttctttttttgcggtcaacaaaattttctcagcattaataataataattttgtcacccatatcaacattaggtgtaaaatgcggataatgctttccgcgtaaacgcgaagcaacaaaagcggctaaacgacccagaattttggattctgcatcaattacaaaccatttttgcttgacttcttggtgcttgacaaaagttgtctgtctcataatcagcctttcattttagtggttttgagtgcaaaaaaaataagaaaaaataataaataagcaaccaaatttttggttgtcaagaatgtattaaaattatacaatattttttaaaaaaacaaaatattttttttaaaaaatattgttaaaataaaagtcggctaaccttatataagttaccaaatcaagctgttgaggtcttatattttgagcaaattgaaaaaaattataaattttttcaatttgctgcttatttagaaaaaaaataagattattatatagagtttttcgtttaaattgaaagcatttttttgtaaaccaaaaaaattgctccgtttttttggcatccaagtttgttctaagatcaaaaaaaacaacagctgaattgattttcggctttggaaaaaacgaatccggtccaactacaaacaattttttgacatgcgctatatattgtgatgcaagcgataattttgaataagttggtgtttttggtttggcaactattcgatcggcgacctcattttgaaccattaagataattttatcaaatttttcaaaatttgcaaagattttaaacaaaatttttgaggtaatatagtaaggaaggttggctataattgtttttttttctttaaattcgagttctgcgagcaaaaaatcttcgttaattatacgaagatttttattcttgaattttttttcaagaattggaattaaatttctatcaatttcataacaagtaacaaattttgctttttcaagtaaaaaatttgttaaaaaaccggttccacaacctatttcgataatttctttgtttttaagatcaatattttcaactattttttcagcaatttttctatcttttaaaaaattctgacctaaatgcttcttaggaaccggtttttgcattttttactttaaaaattttccttacatttctataaattatttcagaaagttctgtttttgtcaaattttttaaatttgctatcgtttgataagttcactgaatttggggagaaacatttggtcaaagttggcgattcggttcagggcttaaataaggcacatcggtttcggtaaaaattttctcaagcggggtttctttaattattcttcttaattcaatgctttttttgaaggtaataactcccgaaaatgaaaaaaaacagttgtttttctttactaatttttgaaatatttcataatttgttgaaaaattatgaaatatgaaattaattttagaaaatttagttacaatttctgaaattaatttcattgcttgattttcacctgacttatcgcgaatatgtaacataactgggattttttttgattttgcgatttgaatttgatccaaaagcgcttttatttggacatcttttggcggattattttcatagtaaaaatcaagaccgacttcgccgatggctaaaactttatcatcaatatgattttcaagtagggaaaaattatcattttctgcgaccaaagttggatgaatccctatgattttatagattttttttgaataattacctatttttttaatttcttcaagatattctcatgaagttccaacaacgaaaataagtccaatattttttttaaaccaattatcaacttgtgcttttgaatcttgaaaatattctgaaaaaggatggcagtgaatgtcgataaattcgtatctttttaccaaattaaacttaaaagtatttgaattgccatcaaaagatatggcaaatttttgaaaaaaattattaatttttgtgtccaaattgctaatttgaacataaaaagtttcaaaatgataattttcttctataaaatcgagaataaattcaccaataatattaattcagtttttatctaaaaactgactaaaaaaaggcagatttagataaaaagtttgttcttttcttgaaagtacaaaaaaagcaaaaataaaatcagcttgtttatgctcatcaacaaccaaaaattcataatttgtttcaaaattttgataataatcaaaattactgattttatttttgcctttttttgttactacatttaattctaaactaaattttttaatagttttctgaaataattctaaataccgcggtaaaaattgctgaatttttaaatacatagttaattttgataattaatagataaaaatttattataattttgttttattataatacaatttttaattataatataaaaggagaaagaaataaaatgaatattgatgcaaaaaaaaatatcatcctttttggaatggaaaattcccttgacttagccaaaaaaatttcgaaaattacaggaatcccactttctgggattgaaagaattgtttatgctgatggcgaagttttactaaaatccaaagaaacaattagaaattcgactgtttttgtagttgcaaatacctcccgccctgttaatgaaaatattatggaacttttaatcttcattgactcgttaaaaagaggttatgcccaagaaattatagtaattctttcttattatggttatgcaagacaagatcgaaaatcatcaggaagacagccaattactgcaaaattagttgcaaatttacttgaaaaagcgggaataaccaagctaattttagtagatattcacaatccaagtattcaaggtttttttgatttttcagttgatgaaattcatggacagtatattcttgcaaacgaacttgtcggaaaaaataaggactatgttgttgtcagtcccgatcatggaggcgcggttcgggcaagaattctagccgaaattttgggtaaacaaacaaatgttgctgtgattgacaaaagaaggacaggcgctaataaatccgaagttttaggactaattggcgatgtagatggaaaagattgtataataattgatgatattatcgatacaggtgggacgataattaatgcagcgaatgtcattagagaaaaaggggcaaaatctgttgttctagccgctactcacggcgtttttagtcatggttttgaaaaatttcaggaaaatcctaatattgacaaagtaataattaccgattcaattgataataaaaaacttgctaaaaagtttcccaaacttttgataacctcgcttgccgaatttttgtcaaaaagtattttagcctgcattttttcgacttcaattacaagtatttatgaagaaactaagcaaaaattaattaaaaagaacctaaattaaacacttttttaaaagatttgaaatgtataaacgattagttcaggaattctttcctaaattagattttgaaaatttagaaaaatacgtaaatttaattgaatttagtaataaaaactttaatttaaccgctttttctggtgatattctctgaaaagagggaatttttgagtcaatttttacaatgaatttcattgttggtctagtaaataataaagaaaataaaaaattaaaaattttggatattggggctggatcaggttttccttcaattccttttttgattacaaacccagaaattgagctaacaatttctgagtcaatgcaaaaaagatgccagtttttaaaggatgtttctgaaaaattagatttgaaattcaatttaatttgcaaaccagttcaagaaattaatccacaaaaatttgatataataactgccagagcagtggcaaatttggaaaagcttgagaaaattacaaaaaaaattcattttccaaaaacgcttttagcttttattaaagggcccaaagtttttaatgaagttcaaaattgtaaaaattgtaattataaaatcattaaagttaataataatataaataaaaaaatttttatcgcatttaaacaagtttcttaataattttgaattttaatttagaaaatataaaaatcttgttgatttttatataattttttaaccttttttttttttttttttttttaggaatatggtaaaatttagtccatctatcaaaaatatagaaaaggaaaaattatgaagaaaaaagcaagaaaattcttaagactaacttcgcttacactagcgcctttttcggtcttcaccactcttatttcagctggttgtttgcaaaaaaattctttgctttcagaagtaaattatttagccctaggtgattcactaacagctggatttaatgaagaaacataccgtgattttcaaggtactttagataaagatggtaatttaagcggtcaatcttatcctgcttattttgcttattatctacaaaaacttaataagaattcacttgtttcttatgataatttggcaatttctgggacaacaacagaaaactgactttaccttcttaatccaaccaaatatccaaatggaaaaatgagcgataatccgttagttacaaactattcaggaaatgaaaaatataatgaaataggctctgtttttggtgattttaataaggattcctatcctggtttagtcgaaaaagttaaaaaagcaaaccttttgacaatgtcagtgggagctaacgatccttttttagcaatttttaatgaatttaaaaaatgagcaagtataataaaaccaaaatcagaggaagcaaaaaaattactagatccaaatgaaagagcgaatttcctagcagaaaaaggaatgcttttaaaggcggaagttaataaaaaaattgaggaaataaacacaaatcttgataatttaattaaagaattaaaggcgcttaatccaaaattaagtataaatttagttggatataaattgccaaattccggttttattaagattttaaagtatcttttatatacttatgcaaaaattgaaacggactttatcaatgaaattcccgaaaaaattaacaaaattattcgtgaaaccgccattaaaaataaggtaaattatattgatgtctatgataaaagtatttgaaatgattctgataaaaatttaatggcgaaaaattttgacttccacccttcaattcaaggttataaaaaaattgctcaccaacttttgttaaaattaactcttgaccaagaagaaaaagatgattctaatgctgaagagctaaaaaatactacaaatttcgatgattttgatgagaataaaccgacctattccaaagttattgacctaagtgtttttgcaaaatcaaataaagaatttcttgaaaaattaaacgaaaataagcaaactagtgaatttattgctcaaaaatccacttttgacaccgatcaagaagctgcaatcaaagacgacaaacgcacttttggaaatatagttcgagaaattgtatctttaccaatcttcgataattttgattttagagagttaatacctgttaaaaatccatttgtaaaagcaattattaacagctatttagggaaaccagctggttctcttataaaagatatcgaacaactcgaaaataaagtgaaagattacgcaagacctaatatcaagattttcgatacaattattgactcattcataagaaaaatggtagcattttttgctgaattaaacactgatcaagaaataaaagaattcaaaatgtcacctcaaatactatttctgacactaagaaatgcaatactaagtccatttgatttaactaaattaaaagacagtgctacatttaaaattttaatgaatctcaaaccagaacaaatattaactctactaggcctaggtaaaaccccttcagttcctaaacctgaaaaaccaaaagatcaaggttctatgccacaaacagatacttctagtcaaaaacaagaaagcggaacaggttcaacagattcaacaaaagctacaactgaaaaccaaaaaccagctgagcaaacaaattcttctgagcaatcaagtaccgattctaaatcaaactaattttttaataacttataattataaaaaacctaaacttatttcagtttaggtttttattttctaatttcaaattagaaaataagactttctaaaaaagtcttattaaaatgttaaaaaaaccttgttttttatagacttttttaaattttttattataatatataaggaaaaattttagtatttctgactgtgaaattatgaagttaataaaaattgaaattgaaggttttaaatcctttgctgaacctgtaagtattaaatttgatggttcaattgttggaataattgggccaaatggctctggaaaatccaatataaatgatgcaattaaatgagttttaggcgaaaaatcagttaaacaattacggggccaaaatatggatgatgtcatttttgctggctcaaaaacagttatgcctgttaataaagcgatggtaaaactgacatttttagatgaaactcgtgaagatagtgcccaaattttcacaatttcccgagttatcaaaagaggacaaggaactaatgaatatttttataatgatcaattagttcgctataaagatattagaaatttagcaattcaagctggaatttccaagtcttcacttgcaattatttcccaaggaacgatttctgaaatcgccgaatcaagccctgaacaacgaaaacaagtaatcgaggaagtcgccggaactgcaaaatataaaattgataaaactgaagctctaacaaaattagatcaaaccttgatcgcaattgaaaaaattgaaatcaggacaaaagagcttgaaaaacaagtaaaacagcttgaaaaacaagcagaaaatgcaaaaatttacctcgaaaaatcaaagcaattagaatctgttgaagtcggcttaattgtctctgatattaaaaagtaccaaacagaattagatcaagtccaggaaaaattaaatgatctaaaatttcaagaacctaaatttatcagcgaaattgaagcaaatgagaaaataattattacaaatacacaaaaaaggtcagaaattgaagctgaaatcaacactaaaaaccgcgaaattcaccgcctaaaagagcaaattaataccctaaatttagcttatgcaaaagcaactcaacttcaagaaatgattttatcaagtgaaattagtgtaaattttgagcaaaaaatggctgctttgcgccaaaaatatagtcttataagcgcgcaaaaagacaattttgcaaaattaatcagccaaaacaagctcaaaaaactagaaattgaagaaaaacttaatacatttaggacacaaaagggtgaaattgaaaggaatttatacagtctaaattccgaaaaaattattagtcaaactagaatctccgagctaaaaaagtccttagaatcaatgtcttttttgccaaaggggacaaaaatcattatcgaaaatagctttctttttcctggatattgtgggcttgtctctgatttaatcaaaattttcccaaaatatacaggcgcaattgaagccgcattgggtccaactttaaaacaaattgttgttgaccaacctgaaaccgcagtttcagcaattaattttctaaagaaaaattatgcaggaagcgcaacatttatccccctttcaacattaaaaccgcgatttattcccgatttatatcttgaacatctaaattcacaaaaaggttttataaatttagctagcaatttagtcgattttgaaaaaaaatacaagattttagcggattttttactaggagggattattgttgctgatacaattgattcagcaaatcgaatcgcaaacttccttaaccacaaaaacatgatcgtaactttagacggcgatgttattagaactagcgggataatttctgggggtcataagataaaaaatgattcttccttttcaattcagtataaaatcgatgaactaacaaataatttgaatttttttgaagaaaaaattcaagaatttaaagttaaatctaatgaatttgaacagttaattacaagagaatctgtatttttacagcaaattaatattaatcttaatgatttagagcaaaaatttagtaattctgaaaatgaattaatcgaaattaaagctcaaaatgaaggtcttgaagagagtctaaatcaaaaagatgacctaaatttaagtctaaatcgaactttaaaagaaaaaattgaacttgaaaatgtggttttagaacttgaaaatcaatgcaaaattttaaaaactgaaaaaaaacagctcgataatcaaatttcagaacttacagttttagttcaagaacttaaccaaaaacagcgaaaaatcaacgcagatcttaaccaaaatcaaaattacaaagacaaatatgaatttttaattacaaatttacgaaataatttatcccaaaaatacagtctaacttttgaaggcgcagctcaaaaatatgaacttgaaattcaagaaaaagatgctcgcgaatttgtaaatagtctaaatttagagattaaagcgcttggaaatgttaatttagatgcaattaatgactttgaaacaacgagtcaaagactcgaaaaactaaaaaaaagtcaaaatgaacttgaaactgccaggtcaaaaattttagaagttatctcggatttagataaaattatcattggaaaaacccaggaaattgtcgatctagttaattccgagtttaaccttgttttccagaatatgtttggtgggggaagtgcaaaaatttattttagtgataaaaacgatattttaaattcggggattgaaataagtgcccaaccacctggaaaaactatcaaaaatattaggcttttttctgggggcgaaaaggcaattattgcaatttcacttttgttttcaattattaaggcaagaccaattccgctttgcattcttgatgaagttgaagctgcccttgatgagtcaaatgtgatcagatatgtggaatttctaaagcagttaaaacaaaaaacgcagtttttgatcatcacccatcggcacggaacgatgtcccgagttgatcaacttttaggaatcacgatgcaaaaacgaggagtaagttcaattttttctgttgaactttcaaaggcaaaagatcttttaaaagaacaattacagtaatttttcctaacattttttctaaatttttttgctgaaaaatgttgatatggaaaaagcgaaaatttatggtataatttctaaactaacaaaataataaaatttagaaaaaaggagaaaaacaatggcaagagaaggtttaactctaagatgcactgactgtaaaatggaaaattatattactaaaaaaaacaagaaaaccaaaccagaaaaaattgaagtcaaaaaacactgtcataaatgcaacaaacacactttgcatagagaaaaaaagtaaaatgaaccgcaaatatttagaaaaagcgttttttgataaccatttagatgtaattatttctttttcattccaaagtcgactctgactaacgaaaattgcggcctccgatggaattttatttattgaaaaagatcaagcttttttgtttgttgatggtcgttatattgaaaaagctgaaaaagatgctaaaaattgtcaggtttttttaactaccaaggcaaatcttgaagattttttcaagaaaaaaccgtatcaaaaaatcggcattgaatctgaatatttaactattgaacaatttgataaaataagaagttgatttccaaatgccgattttgttaagttacaagcccaactttttcgaattataaaaacagaagaagaaatcaaaaatatcgaaaaagctgttgaaatctcactcgcggcttataataaaatatttccaaaaatcaaaccgggaatgacggagaaaagtatcgatgtcaacctaaattatcaaatgaagcttttaggagccgaaaaagaatcctttgattcaataattgcaactggttctaattcggcaatgccgcattgaagggcgagtgaaaccgaaattttagataatgatcttttaaaaattgattttggtgcgctttttaacggttattgcgctgatattacaagaacttcttatcttggacagattagtgaaaaaaaattagaaattttggaaatagtaaaaaaagctgctgaaattggtagaaaaaaagttgctcctggggttaaagccagcgaaattgaccttgcttgccggaattttatcaccgaacaaggctatggaaaatattttattcactcaactggccacggggttggtattgatatccatgaattgccagttgttagttcaactagccagacaattttagagcccggaatggtaataactgttgaacccggaatttatatccctggacttggaggcgcaagaattgaggatgttgttttagtaactgaaagtggttttcgtaccttgtcacgaaaaggtgaaagaatttagaattgaatcaaaaataaaaattttttaaccttttagataaaaaaatcattaaaaatgaaaaaagcaaagcgaaattataaaatttggacactaacaaccttagtaccaattttttcaatttctcaaggttgttctgaggttcaaaaattaccggatgtaaatcctgtttctaaggttataaaagccggaaatgaaactaaaaaaattgaggatgaccaagaaaaactagataaaattgaaaaaattgaaattaaaacggtaaaagaacaagaaaaatctgagactaaaaaagtggttcctgtaaaaaaaccagaaaaagttgaaaaaattgaaattaaaactataaaaaaacaggaaaagcttgaaactaatacaaaaaagcagcccgaaataactagtccaaaagtagaaataaaaaaaactattaaaaaaacagaaaatcctggacaaaatgagaaaaatgttgatctaaaaccaagtcaaaaaccagctgaaaaacagcaggaaattaagaaagccgatgttggaataacacgtaaaaaagaagaaattttgaaaaaaaatgagcctgttaaatctctagataaaaatgaaattttacttactgaattaaaggctcatcttggaaatctgccagatcaaattcaggttgctaacgcacgaaaaaatgataacccaatgacattagtttataaagcaacaaatgaatacaaaaatctttcgtattataatattgtaaatccaattggggaggataatgaaaagtatgagctaaaattagacttttttaatgcaaaatacaacaaaaacggacaaaataaagacccaattgaaaatgtaaaactaattttatcgttaaaatctaatcctaatataaaattctccaaagttgttactgttttttatcagaaacaagaaaaaactgaaaaaaattatattttaaaaactaaatttcctgaagaattcaagaatatctatccatcttttatcgcttttttaatccttaatcgcgaaaaagaaaatgttgtttccttacctttttttaatgaagatggagttattcttaaaaataggaaatttggctttggtctgcagaatgaactcgtagaatttaaatctaaaaatctagaaaacgacaaggataaatatacttttgaggttttaagcgccaaagctgatgatgaaaacgggaaattaagtttaaatctaaggctgtgaaaaattaaggatagaactgaaagaaaagaaacttttgctgaaattgagacagtagaaatttctggttttgcgaaaaattccagtaaaaattacgagtttaaactagctgaaaaagattttgagataaatcttttaaaagacaatctaaaaaataaattaacagatgaaaaattgaaatcaagctttaccaaatatgcatttttaaaaattttatttgaaaaaatgcatatttggtcaactattgaaaacgagaaaaaattaataaaaataagtgatctaaggattggaaattgaattgtttacccgcaattgatgtttttagatttaaatcctatcaagtcaattgataatttaattttgacaaaaaacgggaataaaattacttgaaagctaaatttagaaacttatttattagacaaaaatcaaactttaactccacaaagtcaagattttttattaggtcaaaagcaaattcaggaaattcaaggtagtttaaatcttgatcaagtcaaaaaaaattagtaaatttaacctttatttactaatttttaataattttacaaaaatgatgtaaaattattaaatatgaagtctaaaaaaacaaaaaaatatattttcttacttttgaatccggttgcacttcttttcctatcagcaagctgctcgaatacggcgcctgcaacaacaaaaatttctaaagaccaaaaagaggataaaggtactataagaaaagaagtggaaaatcctaaaaaatctgaggaaaaaccaagtactgaaaaatctgaagttagcactaaaaaatctgaaagctctgaagaaaaaattgaagaaaatccaaaaaatgaggccgtagaaaaaaaagatgaaatcgctaaacaaaaagatgaaatttctaaaccaaatggtgaaaatccgcagcctgaattagacaaaccccaagctgaagacgaccatcaagtcgaaaaaatagatgtcaaaccattcaatccaaaagaggatcaaaaagatgatgatatcaaattagcgcaactaaaaggctatctttccaccctgcctaacactctttatattacaacttcactccaaaatgaccttcctttgacaattattcatagcggaaaaggcgagaaaaaagatttaggctatgttaactttgtaaaaccaattcaagactttaatgatactgaatacgaggcaaaacttgatttttctgatgcacaacaaaaagaaaacaagaccaaaaatccaattgaaaatgttggtttagtgcttagtttgaaagacaataaaaaaatcactagttcaaaaaaaattagacttttatatactgaagaacaagaaaataaatcacatttaaaggcaaaaagtttaccggaaagttttaaacatatttttccttcatttttagcttttgcactattaaataaagaaaaagaggtaatttctctgcctttttttaacgaatcaggttatgttttaaacaatcaaaattttggggcgggtcttaaatcaatttttgcagaatttaacaacagtgaaaataataatcaaaaagataaatttggttttgatgttgtcagcgcgcagcctgatgatgaaaagggggaattaaaactaaatttccaactttgaaaaataaatgaaactaacggtgatcaaaaagaaatttttcctaaaatcgaaagtttaactttttcaaacctggcaaaaaattcagataataattacgaaatcaaacttgatgaagcaactacaaatacaaatttaaacaatgaagattttgggctaaaaaacgcgggtgagaatctaaatacatctaaatttaagaagaacgaattcataaaaaaaataatagataatatacgggtgaatattaaagctgaaaatattaataacaagtgactcaaagttagtgaagcaaaatacaaaaattgattgatttttccgcaaattcagtatgcaaatttagactcaacaaaactaattaataatttaaaacttgaaaaacaacaggaaaacaaaatttcttgaactttgaacttagaatcctacttactcgataacaatcaaattctaaccccagacagcgactttattttcggagaacaaaaaaaaacaattacaatcaaaggcgaaatgcaattaagttaagttttgaaagaacaaagggctattattataccacaaagaaaaattaagggaagatttttttatttgtactacctccttttttagtttcgagtgcggacaccataaccgctctaatttttataagtattttttaattctctgcttaaagagcaattggatttttaattataccacaaagaaaaatttagagaagatttaaaaaaaaaaaaaaaaaaaaaaaaaactgaaaagacagggcaaaatcattttctagtgtaaacacagttttttaaattttaatttaaattttaattttttaaactacccacaacaatccagcaccaaccaatcaaatagtttttatattctaccagaaattagaaaaattcaaagaagtttttagaaaaaagtttttaaggcgaggattaaaattcttgactcttacagttattagaaatcattctaccagaaattagaaaaattcaaagaagtttttaaggaaaaagtttttaaggaaaaagtttttaaggaaaaagtttttaaggaaaaagtttttaaggaaaaagtttttaaggaaaaagtttttaaggaaaaagtttttaaggaaaaagtttttaaggaaaaaaacactattttccatagtgtttttttatttttttaattattaattattaattatttatttaatttaaaagttcatttattccctaaatagccccataaagtgtttatataatctctctgctttttcaacagtagcggcttgatcaatactttcatcatcaggaaattcatagatccctaatccttttagggccagatatccatcaccttcatcgtcttgggcttgggtattgttattatttgtagtattttttaaaagccctccgacataatttaaatcatcataattaaattttgtcccttcagcgaaatcaattgttatatgctcaggctcatcagagctatcattagcaatccaccaaagatgaagttttttgtcttgtactagtagaccaagtcttacatcaatttggttcggatcaggattttggcttagattttgacttggcgaagtagttgtttttctttgagtgtttgtaattttaatttgattacgccctgattgttgggtatttgatcgagaattggttgttagactatgcgtacttggggagtattggatttgattgttatctgatggattttcgttttcgagtttggatttaatagtagttcagagaacttccccttgggaattattattcgaaattccaagaactgtctcaccctcggtttttaaagaaccaacagatgttcccagccgggttattcatatttgggtattggagttgttgttggagcctccgttattgttgtcttttatcccagatcctacaagaattcattctttttttgttcccgggttttttatagccccttttagtagtactaactttttatttggtttggagttagtattggtattacctctgctgcttccattttttattccctcttttatcttagtcccaccttttttaacacggagcccctcctcggtgatctcgagcttagtcttttcgggttcaggagatgccatttgaggggaagctaactgacttcaaattagctgcccttctctttctgttttaatctggtttcttcttgtataatctacaagaagtactggatcttcttggactaagtagtcaatgtatttattagccataaccccttttattataagatttcgggttaaggaagttaggtttttactatctggatttgattttgcctgggaagtattttcttttagaatcgctgttatttttagacgatcattaaagctatctggttcaacaaggaaatctcaggtagttcctggtagagttttatattttgaatttactaggaaatcccaaagaattaatccaagtcctaagttttctttatttgttttagtatctaataattggttagtttcttttgttttttcttgtttttgtttttgttcttttacttgttgtttttcttgctcttggaatttagttgtttttactttagccgaagaggctgaagttgctgctgcttgtgttgaacttgttgttgaagttgttgctgaacttgttggtgttgaatttgaacttgaatttggagtttctgtagatttattttgggttgtacccgccatacttgaagaagaagtggttttactattagaatcattagaatttgaagatgaagattctgcttgggctgattcaggttttacttctttttcattttttgcttgatctggttttgcttgacttgttgctgtagcaggttttatttcgttaataaacttgtttttgtgtttctctttatattcttcgaggtcttttttactttgaggtagatgatggaaatctaaataataaagtgttttcgcgacttcatcatctaagaaggttttaccttcctttttatattggataacctctttgactaacttttccattctccctaaagttattcaatctccttcagggttatcctcatattgaaattcgattgctaatagatcgtcattgttaagatctattgggctaaacgtcttactttcaattttagcttgtaattctttttctctttctggattttcctttaataaagtattaattatttctctttgttttgcactatagtcaagttgaactttaaatcttgaagataaatttccaagatctaaaaggacaacttttgaatttgaccccttacctatttttgctagcgaagcttttaaaaccgggggataatttgatctaacctgactagaaactaaataaggggctctaatatcgctaacaacttttttaagactaaaatctactttgagtactacttgttcattttctaataatttttctttttcattttcttcaatatttctatcaaaattaattgaattaactttaagataatataaaggaagatcgggaattggaattagtctcgaccttagatcgaaaaaactaaggaaattttcctttgctttctcgaaagaatcttgctctgatccattagaatttggttcgtttttaagatcctcttcttgaaatttagtagtggatgtattattatccacctttttgttgttattgtgttcttttagtttatctaatattttcctaagatactccggattattatcatttttatagataatttcagacaatgataaattatcacggattaaacctaattgaacataaggtttaatctcaacaaattcagttactttttgaagtactttttcctcttgttttttaagatcaaaatcaagttttttgattcccttaattttaaaatcgtattcggatactaatttaccatttggatctcagagttcaaaagtaatagaaagcgttccatttggatcgcttaagtttttaaaggctaaattttctactttttgtagtttattaacccttgcgcggtcgttttcatttatatttactaatttttcttcgcttgcatttttattttcaattgttttgggggctagcacataacccttttggagcatagtgggcaaaccttggcggttaactaagttataaccaagataattttttatcaaggcctggcgaaaagcctcggctcttgatcctgtttttttatatgcaacttgaaagtcattatcaagccgaaaagccatttctgaggctaaaagatgcgcgctttcaggggctaaggaagaaagtgatagacctgaaagctcttgattaatttgataatctataatatcatcgccaaaatcatcttcttcttttcaaccttttagagaagttagtcttgaataggtaacttgatatttttgggaatatgcactaactactaccgcttttacttctttattagccgcaaaggcatcggaaatatccaaagaaatcttaaatgaatgttttgtaattggggtgtagtcataagtatctaaaaagttaaaggcattagctgcttccctagcaagtcctaatgccattcttgctgttagatgtctatatttatcaaaaagtttaagattttcaactgctcttataaaatcttcttctgagaagattagatctgagtctgattttaaatccacgactttgtttttatcgactcctcctgaaacttgggaactaaatgatttctcaaaaattgttagtccaattgggactgctacaactgtagttgcaattgatgtcaccgaaaatccggttgaaagaattgcttttgctttattatgttgtttctctttttcgtcaaattggttcattacttatcctttcgaagatataatatttttacttcgccgctttagcagcagctgctgcaggagcactagaagaagatcctgaattttggctttccatgtttggcatttgcatctcttgcttacttgtttgctgatttgaggcctctgctccttgataatcatcttttataagtctaacttggaagaaaaatgctgactggggaacttggccttgggaacttgtttctttttgttccttttccttttctttttccttctctttctctttttgttctgcttgctgtttttcttttctaaccacccttaagtgaacaattttagcattttctgcataagcatcatcgcggatagttacaactttgagatcatagtctttattatttttatggactatctcttggattttcttaaatggttcaagagactcaaacccttgactcgaaccagtctgacccatttgttggccattatttgttgttttaacttgatctcattcattttgttttagatagaaaattgaataagctgatgggatagataaaactaatttattcattaattcacgttcttgtttttctttaactccgatattagaacttgcaagataaagcttgataattgttttaggggtagtataaactactttcttagtagttttattataaattttataataataagttagtttatattcaactgcattctcaggtttgtttgtatcggtttcagaagaagatgaagaagaagaagatgaagatgaagaggatgaagaggatgaagactcagtgttattagcctctttctcaaattgtatttgatagtcaagatcttcgtcttggagttgacttcaacttgcaaaatttaatcttttagcctgataatagaaagctaaaagtagatcggctaaattatcaagttttgctgtattttccaagatgaattttttattttcttcagggatagatgagcccttctgttctgtacctgagctgctgccaccattattattttcggtccctaaatactttttagactctgtttcatattttttaactatagcctctatttgagatttaaggctagttaatttacttagaagatcttgctttgtagaagtggtcttagcatctgaagaatcacttgaatctgattttgaatcacttgaatcactactttgggttttaatatttagatctaaaggttgaattttattaagttcactaaaaatcttggtatcgcttatcccagcggataaaagattttgataatctgctaatttagtttttgcctcattaggtaaatataaagttgacatccatccacgttcgtggaattttaaaaactggttattaaaggaaaatccataaattccttggttattacttgatttatctataagtttaattgccttagctcgtctaaagatgccatcctcttcgatctgattaagatctaatttttcttcaggaccaattaaattattagctcttgcaatttcaaataaatattgaagaacttctcttggatctttctggactaaattagcataaaaagcaagaacatcataatcttcttttaggaatttattagattttaagttaacaagtttataatcttttgctaatctttgatctgatctaaactgggaaatatcttttagacttgggaaattttgttttccaactcaagcatctaaaagtgcctcgttagcacgaaaattatacttataagtaaactcggaactaattatttttttaatttcctcaaatctaggatttggcactcctatattttcatcgagatttttaggactagttggactaggacttgaacttggactagctggacttggactagttggactagggcttggactagttggactagaattagttgaatttgcgtcttgctgttggaactccgttgctttaacttgagaaacagatactgcttgacttgttggctgactagctaaattcttatccccatcaattagagcttctagttcttgttttgaaataaaagcagttagtgttgggagtttaacttctttaatttgttcggtttgtgtactagatccagaagaaccttgggtgctagttcctggtagttcactgagttgataaactagtttctgatttagatcgagttctttttgggtatgtcctactttttggtcttttgactcagatgtagtttccttttggaaataagggatgatgaaagtttctgtttttgattttagtaaaacattatctgaatcaccaaagaaacttgatcaaagactaattgttactggaatttcaatatggcttgtaattccatcttgagcatcccttatttttgcatttgcaatatcaaaagtatattcaatcccttgattattactaatgtatttctttagaacgccaagatcaattccaattttattagataaatattcagaattaattttttcttctagtttttgtgatttaagtttattagacctataaaatgttttattaaactctttaagaaagtctctggcacgttttgttctaattttaaatgatttagatggatcaggagttgccggtttttggactggagctttaggagagctttgaatttgagctttaggctgagtttgagcattaggctgcggctgagattgaggttgactctgaggttgaggttgttgttgttgttgtggattcgaactttgctgactaaccggaactaaaattctattttcttgcccttgatctaaattggatcaagctgacacacttgctttaacttgctttggttgcgaagaacttgtctgtggagctaccttaaagtcgctaagctgaagtttgcgcatggttattttgcttaaaattttatcaatttcggcaaaataagtttttttaatctcggtttgttcactttgaggtttttgtgacttttctggggcttgacctggttttagatcggtttcaagattaacaacaaattgatcaactggaactaatttaatctcttccagcatttctgcttcttcaatattaaggccacgaagttcaaatttagcctcatttgtgagtcttgcttttattaaaaaacttggttcagaattagcacttagactaataaaatcatttgtaccagcacgtcttgtaatactaaagtcaaaaattttaccttttttaaaaggtaaaacattattaggatcatcttttaattcatgaatatatctttgaaaatcagggaagtatttcgaaattcttgaaattgcctcttcttggtttccggatttgttaatatctgcggcaaaatcttcaacgcgggtaagaaaaggaattttttgtgatgctaatgaggtttgacttgaagaaaagtcgactgaaaaatcagtttcccgaagattttggatatttgtttgaaaacttttggtgatttttctatgatttgcattaaaatcagctaaggcaaactgggaacgttgagcataagcgatttttttacttaaaattgatgaatatgcggtataattattatctaattggtgttttgcccgaaattgaagggtaaatgtttgatttttatcatcaggaattaaattaataaactcaaaaaaaggtttatttggggcaaaactgacctcaaatttctgaatttttgaatttaccgctgtataaaaagagataaatttattaagatcaattccgggtcttaattttcctgtttcatcgaaaagtaatgcttttatttgtttatatgtagttgaattatcaaagacatcggatttaaaggcaacattatgaacttttgaaactaaactttcaagttcagcgcggggattttcacctttataacgaattcgcgttacaagcccaactgttgttgcaaatactgcaactccgacaatggctgttgctgttactaataatgaattcttattattcttagccatatttctccttatattattataatagacgaagtgatacaataattatactatagaagttaaaaattaaaaaaatttctcctaattatttttattttgaaaaataattttaaggtaaaaaaatgttctgaaatttcttgattggtttttattttaaattataacataacaaaataaaaaaacaagttttttcgttgagagtaaaaaaattattaatatttttaagctctagaccaaaaacaatagttgacaaccaaaagatttgccaaatttatctagaaatttcatttttaaactaataaacttaaaaaataacaaaaagttttttatttaatttttggtttaaccctcattatttattacttattattaatgttaacttatttcatatcatttattaaaaaattctattaaaaatttttgttataattattcttttgaaaaggatttaaaaaattccgagttataacacaaaaatttataattcaatattagaaatctcaaaaatttttgcttaaaatttaatcaaaaattttacctaggaggttcatatgcgttttaacaggctttttagtctagcaaaacttaaatttacaattatttttttagtaatctttataaaagaggcgggatttctaacccatatttttagctacaagtttatttttgagtatttttcagagaaaaaccctacttttaacctaaattggtccctaattttgttgctaatgccgcttgccatttttatcatttttacttttttgaaaggatgaatttttagttatttagaaatggaaatacgcaataaattaagcgatattataatcaaaaaaattcaaaaaagtaattattctgacctaaaatacaataaaaatgcaatgctttcctgatttaattatgatctcaaactcggtttgaatgcaattgaaaatcttttaaatattatttcaccgcttgtttctattatcactggaatttctttgatgatagttttatcaccgcaatgaggttgaattttaattgttactaccttaattctaagtttaattttactaatttttcaagggaaaattagtaatgctgcttcaaaaccagtgatgaaactatcaagtgatagtgaagctttttcaaactataacctcggtcttcttaactcttttaaatcatttttctttcataacaaaaatgaaaaatttaagcaacttttttataaaagttatgaaaatttatccaaagatcaaataaaacaatataagaaattaactaaattaaatgtaattctaactgtcttatttagtatttcgattgtgattgttttaactgaattagcttcgcagagggcaaaccaattatcattcttgatgaagctttttccaatcttgataagaaaaatctcgaaaatctagtgagttttttacttgatcagcaagttacactactatttatccttcataatttagatcaagagttagttgctaaatttgatttttgcttaaatttttcagaaaatcaaatttttcttcaacctgtaactgactaaattaaaaacttagaattaacgaaataacgtatttatgcagaaaacctgggtataaaattcaggtcttttatatttttgccaaaaaaacaaaaaacccccttgagagcgaaggaggtacgaaaaatctcaaggggcatatgaatgaatgcgttactactataaaaaaattttttgcagtcttttttttttttttttttttgtttgttttttgagggagcccaaaggtggccactacaactccctcaaaactgaatagtaattttttgtttttagattgaaatcgatttgttaaaatactttaagaatcaactttttaaactttgaatttattagtattagtcagctgaatgtattgctacacttacacctctaacctatcaacctcatggtctataaggaatttcataaggaatactcatctttgaggaagcttcccgcttagatgctttcagcggttatcttttccgtacttagctacccagctatgcctttggcaagacaactggaacaccagcggtacgtccactccggtcctctcgtactaagagcagctctcatcaatattccaacgcccacatcagatagggaccgaactgtctcacgacgttctgaacccagctcacgtaccgctttaattggcgaacagccaaacccttggaaccgacttcagctccaggatgcgatgagccgacatcgaggtgccaaaccttcccgtcgatgtgatctcttggggaagattagcctgttatccccggggtagcttttatccgttgagcgacggccattccacaatgaaccgccggatcactaagtcctgctttcgcacctgctcgacttgtaggtcttgcagtcaaccacacttttacctttatgctctgcatatggtttccgaccatattgagtgtagctttgaacacctccgttactctttaggaggcgaccgccccagtcaaactacccaccacgcactgtctctcttcctgttaagggaagcaggttagaaaatcaatttattaagggtggtatttcaaggttgactccacaaggactagcgcccttggatcgacatctcccacctatcctacacataataaaccaattctcaatacgaagttatagtaaagctccacggggtcttttcgtcttgatgcgggtaaccagcgttttcactggtaccataatttcaccgagtccaatgttgagacagtagggagatcattgcgcctttcgtgcaggtcaataattagttgacaaggaatttcgctaccttaggaccgttatagttacggccgccgttcacccgggcttcacttgaatgctttgccaataggctaacatctccgcttaaccttcgggcactgggcaggcttcaccctctatacttcggtttacacctttgcagagagctgtgtttttgataaacagttgccccccctattttactgaggccctttaagaaaaagggcatcccttcttgcgaacgtacgggataattttgcagagttccttaacattggttttctcgctcaccttagaatactcatcttggggacgtgtgtccgttcttggtacaggttgttattgaattagcgctagagacttttcttggaaacagagagtcatttaattcggtacttgagtctcctcttccctatgcatcacagcttgaaattaatgtcatacggatttgcctatataactttcttgactgcttaccccacaatccagtaagtggtaaaactatcttttttcgtaatcccatcactccaataacaagtatcggaatattaaccgattatccatcggatacgcttttcagcctctccttaggccctgactaaccctgggtggacgacccttgcccaggaaaccttccccaataggcgtcgaagattctcacttcgaatcgttactcattccggcattctcacttttaatttctccactagtggtcaccctctagcttcagcgaaattaaaacgctctcctaacgtaaacttaaaaagtttacccgcagcttcggtattatgttttagtcccgttacattattggcgcaagatctcttgactagtgagcaattacgcactctttaaatggtggctgcttctaagccaacatcctagttgtttaagaaatttcacaacctttctcacttaacataattttgggaccttagctgacgatctgggttgtttccctcgcgagcgcggacgttatcacccacgttccgactgcatagataagattaatggtattcggagtttgattatagtcagtacagctaggtgccgccattccacattcagtgctctacccccattaattagattctatacgctagccctaaagctatttcggagagaaccagctatctccaggttcgattggaatttcaccgctatccacaagtcatccgggcactttttagcgtactacggttcgaacctccactttgtgttaccaaagtttcattctgctcatggatagatcacctggtttcgggtctatgtcaacaaacttaacgccctatttagactcggtttccctacggctccgctttaatccgcttaaccttgcttgttaacataactcgccggaccatactgcaagatgtacgccatcacacattaacgtgctttgactacttgtaagtaaatggtttcagaatctatttcactcccctctcggggttcttttcacctttccctcacggtactagttcactatcggtgtctgattagtatttagccttaccaggtggtcctggcaaattcagacagggtttcacgtgccccgccctactcaggatacatctatgagattatataatttaatatacagggatatcaccttctatgtcaaagctttccaactttttctactattatataattttctaactcaattaaaatgtcctataaccccgtaaaaacggtttgggctcttcccatttcgctcgccactactttgggaatcattatttattttcttttcctgttgctactaagatgtttcaattcgcaacgtatctcgctgctttaattatgaattcattaaagcgcaatctaggtttgctagattgggttcccccattcggaaatctccgtatcatagtttatttccaactccacgaagcttatcgcaggtaatcacgtccttcatcgactttcagacccaaggcatccaccaaatactcttatttatttaaaaagttaaaactatttttgagtatagcctattttgagataatatatcttaaggtattttaacaattttagcataatctttctttttaattttttaattttcaaaaattaaaaagcaaaaataaactcggtttaatttttaaagatcattagaatattacctgatttttcaatcagaataaaattgttactattcagttttgaaagagctgttttgccttttggcaattttttttgttttgagagctttagagccctcaaaactaggtatatagtccaatttaaaattttacaacaactagattaataaataattataaataaataaggaggaaatgaattaaaaaaatacaaataaaatctataaaaatcttttaatttaataaaaagaataagaataaataatgaaaatgatgttaaaaatgtaaaaatttagaaaaaatttaatctaataaaaggtgtgaataaatttatgttttgtttttggtttttccgtagaaaggaggtgttccatccccacgttctcgtagggataccttgttacgacttcaccccagtcatcggtcctgccttaggcaatggtctccgaagttaactcaccgactttgggcattaccaactcccatggtgtgacgggcggtgtgtacaaaacccgagaacgtattcaccgcagtatagctgacctgcgattactagcgattccgacttcatgaagtcgagttgcagacttcaatccgaactgagactacttttttgagattagcttgacatcactgttttgctgctctttgtagtagccattgtagcacgtgtgttgccccactcgtaagaggcatgatgatttgacgtcgtccccaccttcctccggcttgcgccggcagtatctttagggttctcaactaaatgttagcaactaaagaaaagggttgcgctcgttgcaggacttaacctaacatctcacgacacgagctgacgacaaccatgcaccatctgtgatctcgttagcctcggctatatctctatagttttgcgagaatgtcaagagtgggtaaggttctacgcgtatcatcaaattaaaccacatgctccaccgcttgtgcgggttcccgtcaattcctttaagtttcactcttgcgagcatactactcaggcggatcatttaacgcgttagctgtgttagtgacttttgccaccaactaatgatcatcgtttacggcgtggactaccagggtatctaatcctgtttgctccccacgctttcgtcccttagtgtcaatatatgaccagttagctgccttcgcctattggtgttcttcctaatatctacgtattccaccactccactaggaattccgctaacctcttcataattctattttgccagtatctaaagcggactaaagttgagctttagcatttaactttaaacttaacaaaaaacctacggacgctttacgcccaataattccggataacgcttgcgacctatgtattaccgcggctgctggcacatagtttgccgtcgctttctaataaggtaccgtcaagactagagcatttcctatctagttttttcttcccttacaacagcagtttacatcccgaaagacttcatcctgcacgctgtgtcgctccatcaagctttcgcttattgtggaatattccttactgctgcctcccgtaggagtctgggccgtatctcaatcccagtgtggcggtacaacctcttggccccgctaaacatcatcgtcttggtaggcttttaccctaccaactaactaatgttgcgcacccccatttcttggtgaagcttgaaagctcctttgaataaaaattcatgcaaatttttatcatatccggtattagccactgtttccaatggttatcccagtccaaaaggtaggttaggtacgtgttactcacccatttgctactaaatattttagcgaactaaaatattccgttcaacatgcatgtattaagcacacagctagcgtttatcctgagccaggatcaaactctcatgattgcgtttaatttacaaattacaaattggattttttattatatacctagttttgaaagatctaaaattctactcaccgtttttttgcggtgtaaagataattgtaccataaaaatatttttttcttttcttttttttttttttttttttatcttcccactaactacaaaaacaaatggcaccaaaaacggcggcaattaatattatacaccatttgcgaaaaaaaagaaaaatttaagcttatattatataaataaaggattttgggggttttttggccaggaaaaatgaccaaaaaggtaaaaaattaagattttctctaaagaacagcgaaaaaaaatttcccttaatttctgaaattaattatgtttttctttaaaaaacattaaaataaatacttttttcttgtatttttcaattttaatgtttttttgtatttcctcaagaaaaacataattaaaattaggaaaattatgtattttttcctaattttttcttttttttcagaatttctaccaaaaaaagtataatttaataaaccgaggcaaacaagatgcagaactgaaaaataattttattggccacaggaatttccgctttgatcaccagttttgtctcgattttttgaacaagatacaggaaagaccaattaattaaaaaatatacttctgaatcagaaggcgaaaaaatagaaaaatttccaaatttaaaagaacaagttcttgaactcaaaagtgaaatttgactttttgaatctcttgaagttgttctttataaaataagcaaggaaaattatagaaaaaatcttttccttgaaaatgacggtttagtcgcttgtcttatccaaaaaaatatcgaaaatactgcaaatatagttgctgttgagtatttaaatcaagaaagatttgacaaaaaccttgaaaaattagcggttagtggccttaattttgctagtttttttgaacctttttttgattttatcctaatttcggttaaaattgaaataactgaaatattaaagtttttgaaaatgcttaaaactgacggaattttgatctgaaaataccagaaaaatcaacgacgaaaaattttaagatacttaaaatcgcaaaaaatcgtttttgatgaatatttttactacgattttttgctaattaagaaaaaataaattaaaatttaatgactaccaccaaaaaaaggagtataatatgaaaaacatagttgatgacaaaatcctcttgacccagcaaaaacttgaggaaattgaaaaagagcttgaacatttaatcaatgtcgagcgcgtgaatgtaatccaagaaatcaaagatgcccgttcacaaggtgatctttcagaaaatgccgaatatgatgttgctcgcgaaaaacagggtataattgaatcgcgaatccgtgaattggaaacaattatttccaaagcaaaaataattaaggccgatttagggtcaagcagagtttcaattggctcaaaagttagccttgaaaatgttgaaagtggcgagattcaaactttccaaattgtcagttcaatagatgctgatccttttaagagcaaaatttctaatttttcaccgattgcacaggctcttttaggacaacaccaaggtgatgaagttgaagttgatgtaaatgaaaaatattctgtaagaattttggaagtaattaacgaataatgcgtctttcagtccgtcaatttttccctgattcggctgaaaaatgaaaaaaatttgctaaaattgtaattccagttatatttgctacactttttatctcaataaataattttattgataattttatggtatcacaaataagcggaggaattactgccgtggggatagctaatgtctgaacagcaataattttttcctttattgtctcaattaattcgattggttcaattatttttagccaatattgggggaaaaaacaaagaaagctagccagacaagttaacaatatccggtatattttagcagtcacaaccgttttgatatttgcaattcttgcctggataatcccagatcaaatgctaagtgcggttcagcgaaataaaaatttgacaaatttggataaaaatatttttgaagaagcaaaaagttacctatttataatcgctttttcgtgaattttgtttgcctatattgtcacttcttcagcaattttgcgtgaaattgggataatgaaaattgcgcttttttttactttgctgaccctaatctcaaatgtaagcctaaatttagtgctaatcccgaaaatgggtgttgctggttcagctctggcaacggtaatttcccgttgtataagcgcaattttaatgactttttacatttttttctataaaaaagatatcagaataagcattttaaagctgttcaaaattgaaaaaaaaatttgaaaacagtattttcgccggtttttcgggatgaatttagtaattattacttcacttattatctcaatacgttcgattttatgagcacaaagtttaccgccgggatcaattggcagcgatgacgggactggtttttataaatattggggcatcgggtttctgacaatttccggaatagtaatgacaattgttaacattttactagcaacttttacatcaattcagaccagtgtctcaattgttgtcagccgcaatttaggtcaggataaaattgaaaaagcgcgaaaaaacgcggcaatgttgaaaggttttttatttattgtctcccttgcaatgtcaattttagcactaattgttgtaattattatcacaaaaactaacttaatcacaaagggattagaaattcaggtgcaaaaggggatggaaaattatttcactgaacacaatttagcaataaatctagaaattatccaaaaacagcagggtctggcaactaatttttatcttagtcaaattttttgaatctgccttttaatagtttttctaaacccaatttgagtccaagttaattcctcgcttaacataattcaggctggcggtcgcgcaaattttgccagtttatgtgacttttttatcggaatttcccagtttttatggcagcttcttgttgtttttgtatttttaccgttactaaaagatgtaaaaacaaaactgtttttttcaatgttgattttttatttttctgatatcataaagtggataatttatgaaattttatatctcaaaactaactgagcaataaatttaactctagaaaaaacggcgaaaaaaatactataatttctttacttttttttatttttagattataatttataataatattaataactaaaaatttcagataaaggagaaagttcatgcctagattaacaaatatgaaaatctcttttgtcgctatcttcatatcgattgcggtaattatgttaataattggggtaagattagctccttttgccatcttgcctaatttccgcctttcaattatcgggttgccgattaaaataaccgggtttatttttgggccaattgttggatttttaactggattactcgctgatttaatcacttttttgttcatcccgggggtttattcttgatattatacccttcatctttcgcttgctgggttcattcctggaatttttttctgattttttgtaattaaagggaagaaatgatttgagaaaaaaagtattttaactcgtttagaccagaaaatttttgaacaaaaacagaaaatttttgattttacatattatagaatcgctaacaaccaaaaagatgaaaatttagagcgaaaaatgaagcaaaaattactttttttacaaaaaaaagtaaagagagttgaaagttggcaagaagaaaaatcactgctgaatttttattgaattgccagtaatttaatcctgatttcaattgtagtaacaactatttatgttgttatgtttagctcttcaattgattttagtcagtctcgttttatttccagtaaactttcctttctaattttaacactttttgggacagtttcaatgataattttcctgcttttggcgagatttattaatttttttcgaaaaaatgaaagatatttaacaatcgcgccaattgttgttttttccgcgcttcatgaaccaatcgcaagcattattggggcaagaggagatgtccaatctggggcactaaacaattttgataccgcttttttaagccacatcatcgtttcacctgtaaaaatttgaattaatttatcagttatttattttacagcaaaagcggttgtaccacttgtttataaaaaattttcttattctatcacttaaaaaacggctaatatgactaatttacatcaggaaaaacgtaaaaaactgctttttcataatataaaaaataaatactgaaactattttagcctagaattagaggcaaatcaaggcagttttatatattcttcagataagaatttttttaatgaatttaaaaaaattcttgaagacgaaaatagttataatggttttattctcgaaaataatgaaccttatgaatatcagaaaaacacttgtttttcggattttttgacaaaaaaattttttgagaaaaataaaaataaacttgtaattgaagtacttttatcactttgaagaattgaaccttttaaaattaaaaccaatacaactagaagatacattcagtatttaagtataaaaaatgttgaaaattttttaaaaatgtttgaaaatgaactaaattatcttctcgaaaaccgggcacaagccttcaaatttattgaaaaaattgcaaaaatcaaagaagaataccaaattttaaacaaaaatttttataatttatacctaaaaacagagcttaaaccgaatattgaacaggaaaaattaaatgaaaaattaaaattaagcataccttatcccgaaactaagtttgagaatttaaaatttagccaaacatacgcacaaattgcgcttcaaactattaaaaatgatataaaaaatgtcataaatcatcataatagtctgataaattcatttgattctgacccttataaaatcaaaatttttattactggttataattgttttcttgatttaattaaaagaagtgataattttcgctgattaagttcattgcaaatttatgaaatttatttcaaatttgagcaatgactaataaaacttttaaatcagaaagctcttgaaaatattttaggtacccaaaattttttcaacaacacttttgcagaagaattttgggggttctgaaaacaaaacagccagcaaaaaattcttgaagaacgaaataaaaaagcccaaaaacactttaaagtcaagaaaataaactcttttcacaaggaaaatccctattatcaaaatttaaaaactaacagcaaaactctccttcgggcaaatattttatgacaacacgaagttataaaaatggaaaaaaagttgcgaaacaaaaattttcaaaactctttttttattaaaaggatttgagtttcttcaattgaaaacaaattaaaaaaattaaaagaaaaaatttcaaaagttgagtatgaaaatcattttattttcttaaaagatgcattaagtgatttaaaaaattttttctacttaaaaaatttaaaaaaaattgatgttttccttaaaaaaaatcaattttttattttttgttttgataacaaaataaattttgatatcctttataaaaaatatggagttctaactaatgatgacctattttttttagaaaccaaaaaaatgcaaatgggaaattattcgagatttttatttgatgaatattcatttttacttgagacaaattataaacaaaagctttttcagcactttttcaacaatggcgaaaattcagctcaactttttatttattcgcgcagaacaataaaaccaatcagggattttagtataattttcatcgaaaatggaactttagttgaatatattcgcgaaatcgatctgccactcacgccaaaaacatcttttggaaaatttttctatcagaatggtacttttgaacgcacaaatttaccgcttttagaaacacaattatacaaacaactccaaaacgaagtttttcaaaataattctggcggaattaaaaataattttgaatcttttataaattcctgaattccaataaaagaatttaaactcgaatttgatagtgagaataaaaaatattcgctaaaaaaagatattcttgtaattgatttataaaaggatttttatgaaaaataaatatgattttaaacttgtagaagaaaaaagaaatgaaaaatgacaaaaaaagggcttttttatcgccccaaaacaaacaaaaaagcctttttcaattatttctcctccgccaaatgtaaccggacaactccatcttgggcactcttgaaacgcttttatccaggattcattagtccgttaccacaaattacaaggttttgatgttctgcttctacccagtgtcgatcatgccggaattgccacgcaagtaaaagttgaagaggatttagcaaaaaaagggattaaaaaatctgatcttaaaagagaagaatttataaaaaaatgttatcactgaaaagaaaaacaatatttaaaaatcaaagagcaatgagataaactgggaatttgttatgatttttccaaggaaagattcaccctagatcaggatgctcaaattgctgtaagtgatttttttatcaaattatgagaaaaaaatctaatttatcgcgggcaaaaagcgataaattgagatataaaattacagactgcaatttctaatatcgaagtgatcaacaaacctgttgaacaaaaaatgtactatttaaagtactttttggaaaattctaatgaatttttaacagttgctactacccgaatcgaaacgatatcctctgatgttgccctggcaataaacccaaaagataaaagatatttgcacctggttggcaagaaagtagtccacccgctgacaaaaaagttaatcataattattgctgattcaaatgttagttccgattttggatctgggataatgaaagtttctgctcactcaattcttgactttgaaattatggaaaaacataatttagaatcaaaagattgcatcgataattatggtaatttaaatcacgaagtgccagaatttcaaggtcaaaatcgtttttttgcccgcgacttaattgcaaaaaaacttgaaaaagaaggatttttagctaaaatagaaactgttatttcaaatgttggtttttcccagcgcagtgatgaaattgttgaaattctaaaaaaaccacagtgatttgtaaaaatggatgaacttgctaaaagtttaatttcgcacttaaattcaaaagataaaattaaattctaccccaagaattttgaaaaaaacctgcgaaaatgatttgaaaaaattcatgactgaacgatttcacggcaactttgatggggccacagaattcctgtttgatgtaaaaatgacgaatttaaagtacaaattgactcacctggtcagggttgaattcaggatgaagatgttcttgatacttggttttcttccggaattagtgcttttgcttttcttggttgaccacagaatttcgatctaattaaatcatattttccgacaagtttactcgtgactggctgggatattttatttttttgggtagcgagaatgtatttttcatcactttttataatgaaacaaaagccttttgaaaaggttttgctccacggtttaatccgggatgaaattgggagaaaaatgtcaaaatctctcggaaatggcttagatccgatggaaataattgaaaaatatggctcagatacgctaaggcaggcattaattttcaattctagtcctggaaaagacatcaaattcaacattgaaaagttaaataccgcctgaaatttgaataataaaatctgaaacattgcaaaatatattgcagatttagacactttttttgcaaaacctgaccttattgacctttgaatggaaaataaaatttatattttaaagcggcaaatagtaaaaaatataaaaaaatataattttagcgtgattggaactgaaataaataattttatctacggggatttttcttcacgttatattgaattaattaaaactcgtaaaaacgggttttatgctcgcaaacttttgagaaaagttttaattattttacacccgtttttaccatttttaactgatttcttgatggaaaaaattttcaaaatggaaattttagaacaaaaaatgcctagaattagacagtttaaagaaaaccaaaaagttgaaaatatccttgaaattatagataatttgcgaacttatagagaaaaatttcaaatttctaaaaaaataattttagaatattgtataattaatgacaagttttctaatgctgaaatcgacatcataaacaaactcaccttcggaaaatggctagaaaataaagagttagtaattaaaacaaaaaattttgaaatcgcaattaaagttcctgaagaattgaaaaaagaacaaaaagggcgcgaattaaaagaaattcaatttcttaaatcagaaattttaagggctgaaaaaatccttacaaataaaggatttttagaaaaagctcctagagaaaaaatagatttagaacgaactaaacttgaaaaattaaaggaaaaattagttttttatgagaaaaagtaaagctttttattcagatttttcaattaaaattgaaaaatctgaatcaaatacttcttcttttccttcaaaaggaacaataaatgtttgagtataaaatctaacaaaaggatattcagaatttttatctttttgttcagtatttttttcaaaaaaatcatccggatttaaattttgtttatattcttttgctttataaataaaattcattacagaaatataggaatttagcttgttttttgcacttctttcttcatgcaaattatcattttttctgtgaagtttaaattttattatttttttagaagaatctaaactatcaaaaattaacttataatttggataggccttattatcttgaaatccaaaaacgttaatttcgcttgaattaggctcattgctttttttctctcggaatgcaaaagaatttatcatttgattgacatttatttgcagataattttttttatccgccgaaataattcctttttttaaaattttcacttcaacagatgaataaggaattaatgtacttggcaactttgttttttccctatcgattacagtttttttaccattaagttccaatgcagaaaagccaattgaggtaggaatcataaaaacatatcagaaatccttgaatttttcgtcaacgtgaggtatataaattgaatttgaatcctgatttaaacttttctttttttgttgtaattgccttgtattataatatcgatttatgaaattaaggtaggttatttctgtttttggactaaattttgtagtaaattctggcattaattctaaatttttcccaccatttacagccgaatttaaatcaaacaagaagaatttagcatctttatcttcatatattttctcattattttctggacttaattcaattaaattcggtgaatttactattttttttaattttttcgcattctcaataccagtttgactttctcttgaaatatttaacccgaaatgggttgaaccacaactaactaaaacaaaaaaagcgccacctaaaaaaacaaaactaggcaaaaaataatttaaattcttatatatttttaattttttcatagtcgaatttaaaaatatttaagcgttttgatcccttagtttctaaaaattccttaaccataacagaataagaatttgatctaaaaattatctttcttttctcgggtgaagtgaaatttcaaagcgaaaagagaaccttatctacaaaaatccggggattttcaagaatttttgtttcaatttggttaggtaaaaatcatttattgtttaaattttctgattctagcaaggaatttaacttctctgaaaagtgttttcaagataatcctgtatcacaaatttgatatttggtaatatgtgaatataaattatctctttctaaatatttaatctctcaattttcaagaaaatcagggtaaagatcaacaaagtccctatctaaattagaatttactgtaccaataattgtaagatttccggggataaaatttttttcctcaggatgagaaaatatatagaaagatagatcaaactgcgaaattccgagcaaactttcaccgttttctccgcgaataaaaagcggttttaaaggagctaatgtgatttttgcggcatcgttgtcgatattttcaagaattaagcaatattttttttctggatttcaataagccttgtgtaaaattcttgcaaaaggaccagggataaagtttaatttttccttagaacctaaaacaaaatcattataaccgataaaactttcagggttataatcatcaaaaaaagtcactatttcatagtttttttcgctgatctctgttttacataattcatttttaatcttagaataaattaaatttgccgaaggggaaattaagagcaagtttttcccactttttattattgtttttttaggctttaatataatttcgtgatttttcttatgaaaatctaatatattaaaaaaattttgcttaaaattagttttatttaacatgttttccaaggaaaagttaaataatttgttaattttatgaataaaataattatagtaatgttccttggaattaactgattttgaaattggatattttgaaatttccctttgcatttcctgttttgcttggtataataacggaagtgaaggaacttttttattagtattagaattatttttttcgcctttattaagataattgctgttgattttaacaaccttttcttgttttgaagaatctatatgttcaagattttctttttctaattggatgtgattacaacatttttcagctgcgcatatttcactttgtgcgttatcttgcagatttttttctccagatggttcagaaattttattaaaatctctttcaaattgatcttggtaaaaattactgtaaaaactgtttttttctatattgtcttcataagttttttcaatttctttttcaacaacattttgttctggacaacaattttgttctaaattattagaaattatgcgaatatcgctctgtttttcttgtattttttcttcaatttcaagtttttcaactgaatttgtggaagttaaatctgcattttcaagagaaatttggtgactttctgcttgatccttatcattaaaatttgcgggtaattctgataaatcaactttattttcttgactattttctaaaatagcttctaattcaatatcaactttttcggggttatttgaaattgtagttgaaatatcttgatttatttgtgtttcttgtaaggaattttctaaatttttctgcacttggttttctaaatgattaattgatgctttaaaatttatagtattatcatttttttcatcaagattatttgactctttttgcataagaacatcaacgatataatcgtaatttgcttgtgaattttgggttaaataatttgatcatttttcagaatctaacctaatcaaacttgctttttcaaaattataactttccagctgattattacatcttttaattaattcatcaatccttgaatatcagtgatcataaagttttattttaaaaaaattaatgttatattgttgattttttccccgagatgataaaacttcaaaaaaaactcctgaaattaaaatataaaaaatatgatctttttgttttaaattgtaacggagtaattttatgttaaattcagcgcaaactggttcgccaaaattaaaattttgaaatatttcatcaacagaaacaggagaattgttctgttttttaagcaattcaagcgtcattttaaaaatatgacgatattcataattgataaaactaactaaattaaacaaaattatgctgatatattctctaattttaataatcccactgtttactaatttggctaatatgttaattttttgttgtccaggagttaaaatatctgtttttgtcactcctaattgtgctgctaattttaagtgttcatttaaatcgccaattggttttcaatttttatttttataaatttttaatcatttatttttaaaattttgattaatttcttcgttatttaaaagaagtgcacggattaaaatttctaaactttcggcttttctaaggtgagtgtttgaaataagtgaccaaatacaaggtgtgattttgtttttcattatatttctccagattgatttttaaacgtttttaaactaataaaattttactaaatttcaagtaaaattttaaaaaaatggggataattttaattaaacccatttttttctttccagtcagggacgcattttttcacgataaaaatttgatttttgcaaataaaatatccccaatgtttgtaaaatttcccatattcccccaataattcaataaatttgaagggatgcctggaaaattaccccaaaaaatatgaaaataatggaaactatgcgctgagttttttgctgtttttttaaagtctcattttcctgcacattcattatccgattcgacttttttttgtttaaaatttttgggataatttgctgcaatgcctgcaccaaaaccgtaacaattattatgggtagataaattcaataaccttcaaaaagtttttgataggaggttgcagctaattccaaacctaaaaaataagtaactttaaaacttggaattccctgcaaagctcgccaaactgctataaaaatcggcattgtcaccaaaatttgtgaaaatggggaaaaaggggaaaagttattttttttatataaatcaacaatttcctgacggtgccgctgctgcatcaccttgtttttcttgtaattttcgtattttgcatcaatttttgcctttttaagttgcagttccatctgtttgttctggccaaaaattgttttaaatctaaaaataaatgaaataatttttgtaaatactacaactgctaaaattgataaaattgttatccaacccgaccattcgtacaatgactgcgaggcggtaactcaaaggataattttcgataacgggtaaacaaaaattgcataaaaagggcctaattttcaggattctgctcaggaaacaatcggaaaagctggaattttgttttgaaaagcaatattttttgctgcactttcatcgttattattccaactataagttttattttggatatcaatccgggaaaaattagttggaaaaacaagtttttttactaaattagcgtatccagaaagtattttttcagtttcaggggaaacatcttttcctgatttttgctcaaattctgcaattgctttttcaagttttccttgagaaaattgcggtaataaaattaatttgttataaattacctgaaaaacatcacgggcaaaaattgcatacgacctattaacgggcggaattttattatctaaattaaaaaaataactatcaattttctcgctaattgcagcattttctgaactagatttatcaaaactataagtatttatgggtaaacttttaacatctcgcagtttttcaaaatattgtttatcagatttaaggctaaaatattttggtgatggaattttaatctctgtccaatttgttttttgctctattgaattttctgaggaactaaaaaaaataaattcattatttttatccccctttaaatactcaaattcattttcgcctttttgaaacattatcagtgaactaaattcaccaaattcggcattttcgttttttatctgttttcttaaagcattgagaattttttcttgatttacttttttattatcagctgatactaaaaaattattattttttgtaactatatcaattccaggtaaatctttgttttttgattccctaaaaattgtgtaatttggagttatttcttcttttgaattataaaattcgagcgcttcaccgggattataagaagtttttacaaccatagactgaatacaaccagttagggaaattccaaaaataattgtatagaaaaaaatctttaagaacttaaaaaaacctttaaatttaaaggtttttttattttgattattttgactttggaaataatcaaaagctttaggtcggatttttctatttttcatttctctttaattctttaaaaattttagctaatttttggtatttggtttcaaagcttaggggtaaaaaattctttctcgcaattaaaactacacgaaaatttaaaaaaatctccccttttttccacaatatataaagcgcatttttaatttgtctcttatagtaattacgtttgactgcgtttgcaaacttttttggtactgaaatcccaatctcaaaaaaatcacttttcacataataaaatataagataattagtgacaatttgattttttttgttaattattgcttgaaattcccaattttttttaatactacgaattttttgcaaaactatctcaacaaaaattatttatcagaaacagttagtcttttccgaccttttgcgcgtcgtgcagcaagaatttttcgcccgtcggctgttgacattcgcgcgcggaatccgtgtgtttttaaatgttttcttttatttggttgataagttcgcttcat

What is claimed is:

1. A composition for eliciting an anti-*Mycoplasma hyopneumoniae* immune response in an animal, said composition comprising an immunologically effective amount of a live avirulent strain of *Mycoplasma hyopneumoniae* wherein the live avirulent strain of *Mycoplasma hyopneumoniae* is a J strain having ATCC accession number 25934 or an isolate thereof whose genome comprises a nucleic acid sequence having at least 95% homology to the nucleic acid sequence of SEQ ID NO.1 and the biologically acceptable adjuvant SP-Oil.

2. The composition of claim 1 wherein said SP-Oil is present at a concentration between about 1% and about 25%.

3. The composition of claim 2 wherein said SP-Oil is present at a concentration of about 10%.

4. The composition of claim 1, further comprising one or more viral antigens selected from the group consisting of a swine influenza virus (SIV) antigen, a porcine reproductive and respiratory syndrome virus (PRRSV) antigen, raccoon poxvirus expressing PRRS or other antigens, TGEV expressing PRRS or other antigens, and a porcine circovirus (PCV) antigen.

5. The composition of claim 4 wherein said one or more viral antigens comprises a Porcine Circovirus Type 1-Type 2 (cPCV1-2) chimera.

6. A method for generating an immune response to *Mycoplasma hyopneumoniae*, or for reducing at least one symptom associated with an infection by *Mycoplasma hyopneumoniae*, said method comprising the step of administering to an animal a composition according to claim 1.

7. The method of claim 6 wherein the step of administering is achieved by parenteral administration.

8. The method of claim 7 wherein the parenteral administration step is achieved by intramuscular injection.

9. The method of claim 6 wherein the step of administering is achieved by oral administration.

10. The method of claim 9 wherein the oral administration step is achieved by hand delivery or mass application.

11. The method of claim 6 wherein the step of administering is achieved by nasal administration.

12. The method of claim 6 wherein said animal is a pig.

13. The composition of claim 1, wherein the composition is an immunogenic composition.

14. The immunogenic composition of claim 13 wherein said SP-Oil is present at a concentration between about 1% and about 25%.

15. The immunogenic composition of claim 14 wherein said SP-Oil is present at a concentration of about 10%.

16. The immunogenic composition of claim 13, further comprising one or more viral antigens selected from the group consisting of a swine influenza virus (SIV) antigen, a porcine reproductive and respiratory syndrome virus (PRRSV) antigen, Raccoon Poxvirus expressing PRRS or other antigens, TGEV expressing PRRS or other antigens, and a porcine circovirus (PCV) antigen.

17. The immunogenic composition of claim 16 wherein said one or more viral antigens comprises a Porcine Circovirus Type 1-Type 2 (cPCV1-2) chimera.

18. A method for enhancing an immune response to *Mycoplasma hyopneumoniae*, said method comprising the step of administering a single or multiple doses of an immunogenic composition to an animal according to claim 13.

19. The method of claim 18, wherein the live avirulent strain of *Mycoplasma hyopneumoniae* is a *Mycoplasma hyopneumoniae* J strain designated as ATCC accession number 25934 or 27715.

20. The method of claim 19, wherein the live avirulent strain of *Mycoplasma hyopneumoniae* is a *Mycoplasma hyopneumoniae* J strain designated as ATCC accession number 27715.

21. A method for enhancing an immune response to *Mycoplasma hyopneumoniae*, said method comprising the steps of:
a) at a first time, administering a first immunogenic composition according to claim 1 comprising an immunologically effective amount of a live avirulent *Mycoplasma hyopneumoniae* strain adjuvanted with a biologically acceptable adjuvant material to an animal;
b) at a second time, administering a second immunogenic composition according to claim 1 comprising an immunologically effective amount of a live avirulent *Mycoplasma hyopneumoniae* adjuvanted with a biologically acceptable adjuvant material to an animal.

22. The method of claim 21 wherein the isolate of ATCC accession number 25934 is a strain having ATCC accession number 27715.

23. The composition of claim 1, wherein the isolate of ATCC accession number 25934 is a strain having ATCC accession number 27715.

* * * * *